US006936252B2

(12) United States Patent
Gilbert et al.

(10) Patent No.: US 6,936,252 B2
(45) Date of Patent: Aug. 30, 2005

(54) STREPTOCOCCUS PNEUMONIAE PROTEINS AND NUCLEIC ACID MOLECULES

(75) Inventors: Christophe Francois Guy Gilbert, Villeurbanne cedex (FR); Philip Michael Hansbro, Newcastle (AU)

(73) Assignee: Microbial Technics Limited, Cambridge (GB)

(*) Notice: Subject to any disclaimer, the term of this patent is extended or adjusted under 35 U.S.C. 154(b) by 269 days.

(21) Appl. No.: 09/769,787

(22) Filed: Jan. 26, 2001

(65) Prior Publication Data

US 2003/0091577 A1 May 15, 2003

Related U.S. Application Data

(63) Continuation of application No. PCT/GB99/02451, filed on Jul. 27, 1999.
(60) Provisional application No. 60/125,164, filed on Mar. 19, 1999.

(30) Foreign Application Priority Data

Jul. 27, 1998 (DE) .............................. 9816337

(51) Int. Cl.[7] .................. A61K 39/02; C12P 29/06; C12N 1/20; C07H 21/04

(52) U.S. Cl. ................. 424/190.1; 424/184.1; 424/185.1; 424/244.1; 435/69.1; 435/252.3; 435/320.1; 435/325; 536/23.7

(58) Field of Search ............. 435/69.1, 252.3, 435/320.1, 325; 536/23.7; 424/184.1, 185.1, 190.1, 244.1

(56) References Cited

U.S. PATENT DOCUMENTS 6,420,135 B1 * 7/2002 Kunsch et al.

FOREIGN PATENT DOCUMENTS

| EP | 0622081 | 11/1994 |
| WO | WO 95 06732 | 3/1995 |
| WO | WO 98 18931 | 5/1998 |

OTHER PUBLICATIONS

Rudinger et al, in "Peptide Hormones", edited by Parsons, J.A., University Park Press, Jun. 1976, p. 6.*
Burgess et al., The Journal of Cell Biology, 111:2129–2138, 1990.*
Lazar et al., Molecular and Cellular Biology, 8(3): 1247–1252, 1988.*
Jobling et al. (Mol. Microbiol, 1991, 5(7): 1755–67.*
Siber, George; "Pneumococcal Disease: Prospects for a New Generation of Vaccines"; Science, vol. 265, 1385–1387 (1994).
Stansfield, Sally; "Acute respiratory infections in the developing world: strategies for prevention, treatment and control", Pediatric Infect Dis. Journal, vol. 6, 622–629 (1987).
Breiman, Robert, et al.; "Pneumococcal Bacteremia in Charleston County, South Carolina", Arch Intern Med. vol. 150, 1401–1405 (1990).
Schappert, Susan; "Office Visits for Otitis Media: United States, 1975–90", Advance Data, vol. 214, 1–19 (1992).
Breiman, Robert, et al.; "Emergence of Drug–Resistant Pneumococcal Infections in the United States", JAMA, vol. 271, 1831–1835 (1994).
Donnelly, John, et al.; "DNA Vaccines", Annual Rev. Immunol., vol. 15, 617–648, (1997).

(Continued)

*Primary Examiner*—Mark Navarro
*Assistant Examiner*—Padma Baskar
(74) *Attorney, Agent, or Firm*—Hunton & Williams LLP

(57) ABSTRACT

Novel protein antigens from *Streptococcus pneumoniae* are disclosed, together with nucliec acid sequences encoding them. Their use in vaccines and in screening methods is also described.

3 Claims, 2 Drawing Sheets

OTHER PUBLICATIONS

Köhler, G. et al.; "Continuous cultures of fused cells secreting antibody of predefined specificity", Nature, vol. 256, 495–497 (1975).

Dougall, William, et al.; "Antibody –structure–based design of pharmacological agents", Tibtech, vol. 12, 372–379, (1994).

Takeda, Shun–ichi, et al.; "Construction of chimaeric processed immunoglobulin genes containing mouse variable and human constant region sequences", Nature, vol. 314, 452–454 (1985).

Morrison, Sherie, et al.; "Chimeric human antibody molecules: Mouse antigen–binding domains with human constant region domains", Proc. Natl. Acad. Sci. USA, vol. 81, 6851–6855, (1984).

Li, Jing, et al.; "Inactivation of the α C protein antigen gene, bca, by a novel shuttle/suicide vector results in attenuation of virulence and immunity in group B Streptococcus", Proc. Natl. Acad. Sci. USA, vol. 94, 13251–13256 (1997).

Pearson, W., et al.; "Improved tools for biological sequence comparison", Proc. Natl. Acad. Sci. USA, vol. 85, 2444–2448 (1988).

Zhang, Dong–ji, et al.; "DNA Vaccination with the Major Outer–Membrane Protein Gene Induces Acquired Immunitiy to *Chlamydia trachomatis* (Mouse Pneumonitis) Infection", The Journal of Infectious Diseases, vol. 176, 1035–1040 (1997).

Kurar, Ercan, et al.; "Nucleic acid vaccination of *Brucella abortus* ribosomal L7/L12 gene elicits immune response", Vaccine, vol. 15, 1851–1857, (1997).

Anderson, Richard, et al.; "Immune Response in Mice following Immunization with DNA Encoding Fragment C of Tetanus Toxin", Infection and Immunity, vol. 64, 3168–3173, (1996).

* cited by examiner

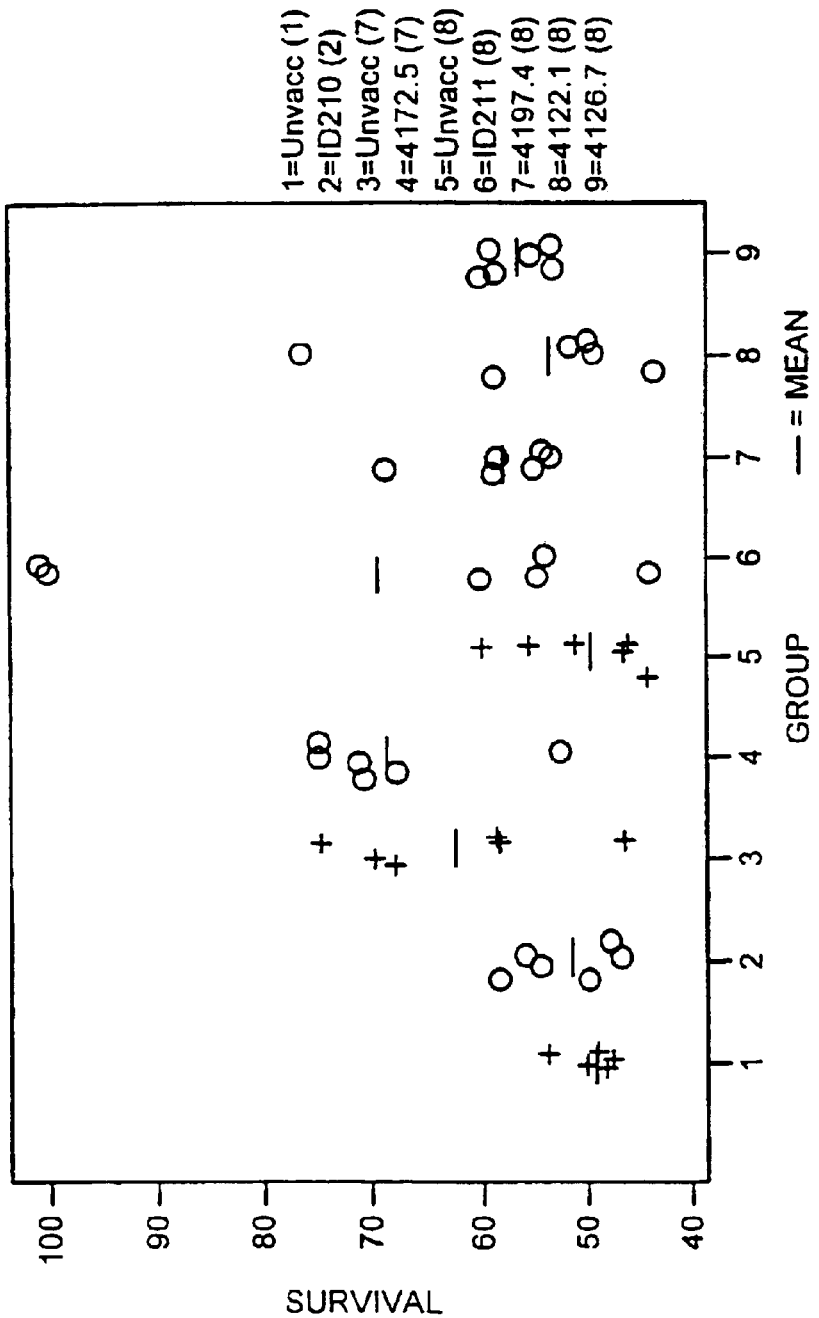

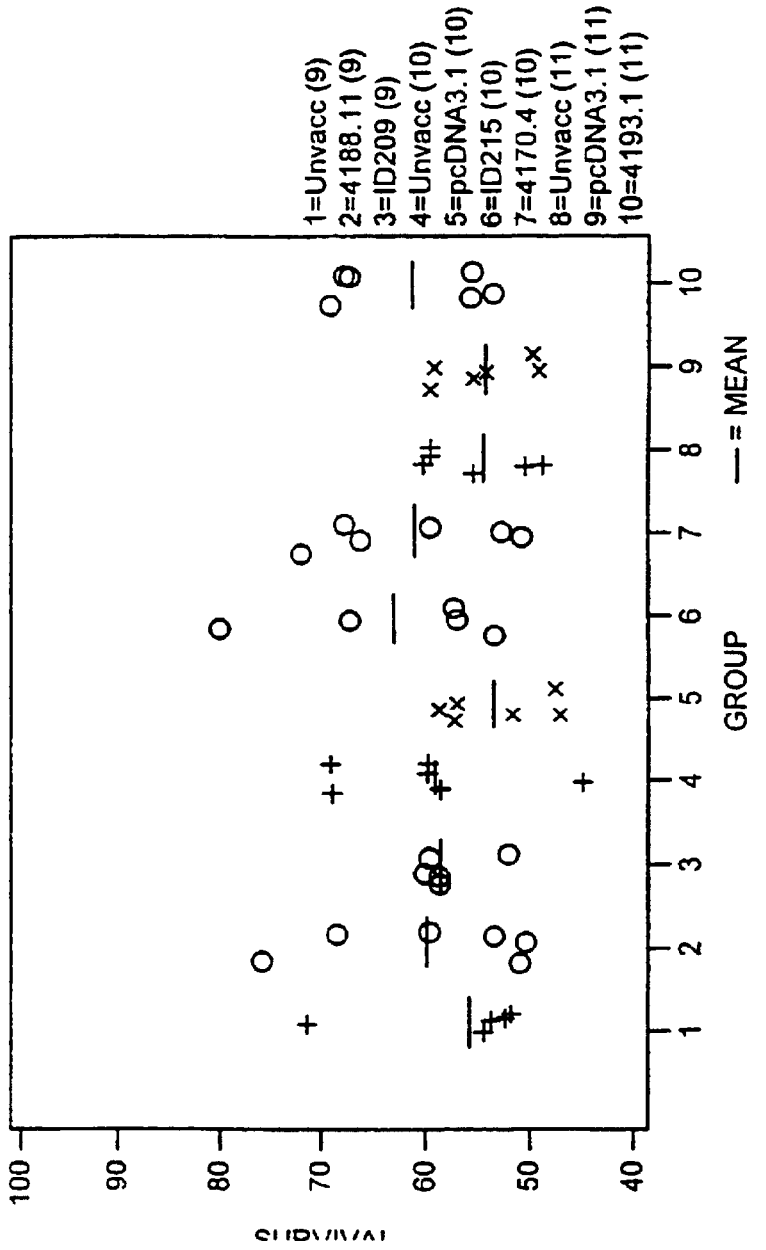

STREPTOCOCCUS PNEUMONIAE PROTEINS AND NUCLEIC ACID MOLECULES

This application is based on Provisional Application No. 60/125,164 filed Mar. 19, 1999 and is a continuation of International Application PCT/GB99/02451 filed Jul. 27, 1999, the disclosure of each being incorporated herein by reference in its entirety.

The present invention relates to proteins derived from *Streptococcus pneumoniae*, nucleic acid molecules encoding such proteins, the use of the nucleic acid and/or proteins as antigens/immunogens and in detection/diagnosis, as well as methods for screening the proteins/nucleic acid sequences as potential anti-microbial targets.

BACKGROUND OF THE INVENTION

*Streptococcus pneumoniae*, commonly referred to as the pneumococcus, is an important pathogenic organism. The continuing significance of *Streptococcus pneumoniae* infections in relation to human disease in developing and developed countries has been authoritatively reviewed (Fiber, G. R., Science, 265:1385–1387 (1994)). That indicates that on a global scale this organism is believed to be the most common bacterial cause of acute respiratory infections, and is estimated to result in 1 million childhood deaths each year, mostly in developing countries (Stansfield, S. K., *Pediatr. Infect. Dis.*, 6:622 (1987)). In the USA it has been suggested (Breiman et al., *Arch. Intern. Med.*, 150:1401 (1990)) that the pneumococcus is still the most common cause of bacterial *pneumoniae*, and that disease rates are particularly high in young children, in the elderly, and in patients with predisposing conditions such as asplenia, heart, lung, and kidney disease, diabetes, alcoholism, or with immunosuppressive disorders, especially AIDS. These groups are at higher risk of pneumococcal septicaemia and hence meningitis and therefore have a greater risk of dying from pneumococcul infection. The pneumococcus is also the leading cause of otitis media and sinusitis, which remain prevalent infections in children in developed countries, and which incur substantial costs.

The need for effective preventative strategies against pneumococcal infection is highlighted by the recent emergence of penicillin-resistant pneumococci. It has been reported that 6.6% of pneumoccal isolates in 13 US hospitals in 12 states were found to be resistant to penicillin and some isolates were also resistant to other antibiotics including third generation cyclosporins (Schappert, S. M., *Vital and Health Statistics of the Centres for Disease Control/National Centre for Health Statistics*, 214:1 (1992)). The rates of penicillin resistance can be higher (up to 20%) in some hospitals (Breiman et al, J. Am. Med. Assoc., 271: 1831 (1994)). Since the development of penicillin resistance among pneumococci is both recent and sudden, coming after decades during which penicillin remained an effective treatment, these findings are regarded as alarming.

For the reasons given above, there are therefore compelling grounds for considering improvements in the means of preventing, controlling, diagnosing or treating pneumococcal diseases.

Various approaches have been taken in order to provide vaccines for the prevention of pneumococcal infections. Difficulties arise for instance in view of the variety of serotypes (at least 90) based on the structure of the polysaccharide capsule surrounding the organism. Vaccines against individual serotypes are not effective against other serotypes and this means that vaccines must include polysaccharide antigens from a whole range of serotypes in order to be effective in a majority of cases. An additional problem arises because it has been found that the capsular polysaccharides (each of which determines the serotype and is the major protective antigen) when purified and used as a vaccine do not reliably induce protective antibody responses in children under two years of age, the age group which suffers the highest incidence of invasive pneumococcal infection and meningitis.

A modification of the approach using capsule antigens relies on conjugating the polysaccharide to a protein in order to derive an enhanced immune response, particularly by giving the response T-cell dependent character. This approach has been used in the development of a vaccine against *Haemophilus influenzae*. There are issues of cost concerning both the multi-polysaccharide vaccines and those based on conjugates.

A third approach is to look for other antigenic components which offer the potential to be vaccine candidates. In the present application we provide a group of proteins antigens which are secreted/exported proteins.

BRIEF SUMMARY OF THE INVENTION

Thus, in a first aspect the present invention provides a *Streptococcus pneumoniae* protein or polypeptide having a sequence selected from those shown in Table 2 herein.

A protein or polypeptide of the present invention may be provided in substantially pure form. For example, it may be provided in a form which is substantially free of other proteins.

In a preferred embodiment, a protein or polypeptide having an amino acid sequence as shown in Table 3 is provided.

The invention encompasses any protein coded for by a nucleic acid sequence as shown in Table 1 herein.

DETAILED DESCRIPTION OF THE INVENTION

As discussed herein, the proteins and polypeptides of the invention are useful as antigenic material. Such material can be "antigenic" and/or "immunogenic". Generally, "antigenic" is taken to mean that the protein or polypeptide is capable of being used to raise antibodies or indeed is capable of inducing an antibody response in a subject. "Immunogenic" is taken to mean that the protein or polypeptide is capable of eliciting a protective immune response in a subject. Thus, in the latter case, the protein or polypeptide may be capable of not only generating an antibody response and in addition non-antibody based immune responses.

The skilled person will appreciate that homologues or derivatives of the proteins or polypeptides of the invention will also find use in the context of the present invention, ie as antigenic/immunogenic material. Thus, for instance proteins or polypeptides which include one or more additions, deletions, substitutions or the like are encompassed by the present invention. In addition, it may be possible to replace one amino acid with another of similar "type". For instance replacing one hydrophobic amino acid with another. One can use a program such as the CLUSTAL program to compare amino acid sequences. This program compares amino acid sequences and finds the optimal alignment by inserting spaces in either sequence as appropriate. It is possible to calculate amino acid identity or similarity (identity plus conservation of amino acid type) for an optimal alignment. A program like BLASTx will align the longest stretch of similar sequences and assign a value to the fit. It is thus possible to obtain a comparison where several regions of similarity are found, each having a different score. Both types of analysis are contemplated in the present invention.

In the case of homologues and derivatives, the degree of identity with a protein or polypeptide as described herein is less important than that the homologue or derivative should retain its antigenicity or immunogenicity to *streptoccocus pneumoniae*. However, suitably, homologues or derivatives having at least 60% similarity (as discussed above) with the proteins or polypeptides described herein are provided.

Preferably, homologues or derivatives having at least 70% similarity, more preferably at least 80% similarity are provided. Most preferably, homologues or derivatives having at least 90% or even 95% similarity are provided.

In an alternative approach, the homologues or derivatives could be fusion proteins, incorporating moieties which render purification easier, for example by effectively tagging the desired protein or polypeptide. It may be necessary to remove the "tag" or it may be the case that the fusion protein itself retains sufficient antigenicity to be useful.

In an additional aspect of the invention there are provided antigenic fragments of the proteins or polypeptides of the invention, or of homologues or derivatives thereof.

For fragments of the proteins or polypeptides described herein, or of homologues or derivatives thereof, the situation is slightly different. It is well known that is possible to screen an antigenic protein or polypeptide to identify epitopic regions, ie those regions which are responsible for the protein or polypeptide's antigenicity or immunogenicity. Methods for carrying out such screening are well known in the art. Thus, the fragments of the present invention should include one or more such epitopic regions or be sufficiently similar to such regions to retain their antigenic/immunogenic properties. Thus, for fragments according to the present invention the degree of identity is perhaps irrelevant, since they may be 100% identical to a particular part of a protein or polypeptide, homologue or derivative as described herein. The key issue, once again, is that the fragment retains the antigenic/immunogenic properties.

Thus, what is important for homologues, derivatives and fragments is that they possess at least a degree of the antigenicity/immunogenicity of the protein or polypeptide from which they are derived.

Gene cloning techniques may be used to provide a protein of the invention in substantially pure form, These techniques are disclosed, for example, in J. Sambrook et al *Molecular Cloning* 2nd Edition, Cold Spring Harbor Laboratory Press (1989). Thus, in a fourth aspect, the present invention provides a nucleic acid molecule comprising or consisting of a sequence which is:

(i) any of the DNA sequences set out in Table 1 or their RNA equivalents;

(ii) a sequence which is complementary to any of the sequences of (i);

(iii) a sequence which codes for the same protein or polypeptide, as those sequences of (i) or (ii);

(iv) a sequence which is has substantial identity with any of those of (i), (ii) and (iii);

(v) a sequence which codes for a homologue, derivative or fragment of a protein as defined in Table 1.

In a fifth aspect the present invention provides a nucleic acid molecule comprising or consisting of a sequence which is:

(i) any of the DNA sequences set out in Table 4 or their RNA equivalents;

(ii) a sequence which is complementary to any of the sequences of (i);

(iii) a sequence which codes for the same protein or polypeptide, as those sequences of (i) or (ii);

(iv) a sequence which is has substantial identity with any of those of (i), (ii) and (iii);

(v) a sequence which codes for a homologue, derivative or fragment of a protein as defined in Table 4.

The nucleic acid molecules of the invention may include a plurality of such sequences, and/or fragments. The skilled person will appreciate that the present invention can include, novel variants of those particular novel nucleic acid molecules which are exemplified herein. Such variants are encompassed by the present invention. These may occur in nature, for example because of strain variation. For example, additions, substitutions and/or deletions are included. In addition, and particularly when utilising microbial expression systems, one may wish to engineer the nucleic acid sequence by making use of known preferred codon usage in the particular organism being used for expression. Thus, synthetic or non-naturally occurring variants are also included within the scope of the invention.

The term "RNA equivalent" when used above indicates that a given RNA molecule has a sequence which is complementary to that of a given DNA molecule (allowing for the fact that in RNA "U" replaces "T" in the genetic code).

When comparing nucleic acid sequences for the purposes of determining the degree of homology or identity one can use programs such as BESTFIT and GAP (both from the Wisconsin Genetics Computer Group (GCG) software package) BESTFIT, for example, compares two sequences and produces an optimal alignment of the most similar segments. GAP enables sequences to be aligned along their whole length and finds the optimal alignment by inserting spaces in either sequence as appropriate. Suitably, in the context of the present invention compare when discussing identity of nucleic acid sequences, the comparison is made by alignment of the sequences along their whole length.

Preferably, sequences which have substantial identity have at least 50% sequence identity, desirably at least 75% sequence identity and more desirably at least 90 or at least 95% sequence identity with said sequences. In some cases the sequence identity may be 99% or above.

Desirably, the term "substantial identity" indicates that said sequence has a greater degree of identity with any of the sequences described herein than with prior art nucleic acid sequences.

It should however be noted that where a nucleic acid sequence of the present invention codes for at least part of a novel gene product the present invention includes within its scope all possible sequence coding for the gene product or for a novel part thereof.

The nucleic acid molecule may be in isolated or recombinant form. It may be incorporated into a vector and the vector may be incorporated into a host. Such vectors and suitable hosts form yet further aspects of the present invention.

Therefore, for example, by using probes based upon the nucleic acid sequences provided herein, genes in *Streptococcus pneumoniae* can be identified. They can then be excised using restriction enzymes and cloned into a vector. The vector can be introduced into a suitable host for expression.

Nucleic acid molecules of the present invention may be obtained from *S.pneumoniae* by the use of appropriate probes complementary to part of the sequences of the nucleic acid molecules. Restriction enzymes or sonication techniques can be used to obtain appropriately sized fragments for probing.

Alternatively PCR techniques may be used to amplify a desired nucleic acid sequence. Thus the sequence data provided herein can be used to design two primers for use in PCR so that a desired sequence, including whole genes or fragments thereof, can be targeted and then amplified to a high degree. One primer will normally show a high degree of specificity for a first sequence located on one strand of a DNA molecule, and the other primer will normally show a high degree of specificity for a second sequence located on the complementary strand of the DNA sequence and being spaced from the complementary sequence to the first sequence.

Typically primers will be at least 15–25 nucleotides long.

As a further alternative chemical synthesis may be used. This may be automated. Relatively short sequences may be chemically synthesised and ligated together to provide a longer sequence.

In yet a further aspect the present invention provides an immunogenic/antigenic composition comprising one or more proteins or polypeptides selected from those whose sequences are shown in Tables 24, or homologues or derivatives thereof, and/or fragments of any of these. In preferred embodiments, the immunogenic/antigenic composition is a vaccine or is for use in a diagnostic assay.

In the case of vaccines suitable additional excipients, diluents, adjuvants or the like may be included. Numerous examples of these are well known in the art.

It is also possible to utilise the nucleic acid sequences shown in Table 1 in the preparation of so-called DNA vaccines. Thus, the invention also provides a vaccine composition comprising one or more nucleic acid sequences as defined herein. The use of such DNA vaccines is described in the art. See for instance, Donnelly et al, *Ann. Rev. Immunol.*, 15:617–648 (1997).

As already discussed herein the proteins or polypeptides described herein, their homologues or derivatives, and/or fragments of any of these, can be used in methods of detecting/diagnosing *S.pneumoniae*. Such methods can be based on the detection of antibodies against such proteins which may be present in a subject. Therefore the present invention provides a method for the detection/diagnosis of *S.pneumoniae* which comprises the step of bringing into contact a sample to be tested with at least one protein, or homologue, derivative or fragment thereof, as described herein. Suitably, the sample is a biological sample, such as a tissue sample or a sample of blood or saliva obtained from a subject to be tested.

In an alternative approach, the proteins described herein, or homologues, derivatives and/or fragments thereof, can be used to raise antibodies, which in turn can be used to detect the antigens, and hence *S.pneumoniae*. Such antibodies form another aspect of the invention. Antibodies within the scope of the present invention may be monoclonal or polyclonal.

Polyclonal antibodies can be raised by stimulating their production in a suitable animal host (e.g. a mouse, rat, guinea pig, rabbit, sheep, goat or monkey) when a protein as described herein, or a homologue, derivative or fragment thereof, is injected into the animal. If desired, an adjuvant may be administered together with the protein. Well-known adjuvants include Freund's adjuvant (complete and incomplete) and aluminium hydroxide. The antibodies can then be purified by virtue of their binding to a protein as described herein.

Monoclonal antibodies can be produced from hybridomas. These can be formed by fusing myeloma cells and spleen cells which produce the desired antibody in order to form an immortal cell line. Thus the well-known Kohler & Milstein technique (*Nature* 256 (1975)) or subsequent variations upon this technique can be used.

Techniques for producing monoclonal and polyclonal antibodies that bind to a particular polypeptide/protein are now well developed in the art. They are discussed in standard immunology textbooks, for example in Roitt et al, *Immunology* second edition (1989), Churchill Livingstone, London.

In addition to whole antibodies, the present invention includes derivatives thereof which are capable of binding to proteins etc as described herein. Thus the present invention includes antibody fragments and synthetic constructs. Examples of antibody fragments and synthetic constructs are given by Dougall et al in *Tibtech* 12 372–379 (September 1994).

Antibody fragments include, for example, Fab, F(ab')$_2$ and Fv fragments. Fab fragments (These are discussed in Roitt et al [supra]). Fv fragments can be modified to produce a synthetic construct known as a single chain Fv (scFv) molecule. This includes a peptide linker covalently joining $V_h$ and $V_l$ regions, which contributes to the stability of the molecule. Other synthetic constructs that can be used include CDR peptides. These are synthetic peptides comprising antigen-binding determinants. Peptide mimetics may also be used. These molecules are usually conformationally restricted organic rings that mimic the structure of a CDR loop and that include antigen-interactive side chains.

Synthetic constructs include chimaeric molecules. Thus, for example, humanised (or primatised) antibodies or derivatives thereof are within the scope of the present invention. An example of a humanised antibody is an antibody having human framework regions, but rodent hypervariable regions. Ways of producing chimaeric antibodies are discussed for example by Morrison et al in PNAS, 81, 6851–6855 (1984) and by Takeda et al in Nature. 314, 452454 (1985).

Synthetic constructs also include molecules comprising an additional moiety that provides the molecule with some desirable property in addition to antigen binding. For example the moiety may be a label (e.g. a fluorescent or radioactive label). Alternatively, it may be a pharmaceutically active agent.

Antibodies, or derivatives thereof, find use in detection/diagnosis of *S.pneumoniae*. Thus, in another aspect the present invention provides a method for the detection/diagnosis of *S.pneumoniae* which comprises the step of bringing into contact a sample to be tested and antibodies capable of binding to one or more proteins described herein, or to homologues, derivatives and/or fragments thereof.

In addition, so-called "Affibodies" may be utilised. These are binding proteins selected from combinatorial libraries of an alpha-helical bacterial receptor domain (Nord et al,) Thus, Small protein domains, capable of specific binding to different target proteins can be selected using combinatorial approaches.

It will also be clear that the nucleic acid sequences described herein may be used to detect/diagnose *S.pneumoniae*. Thus, in yet a further aspect, the present invention provides a method for the detection/diagnosis of *S.pneumoniae* which comprises the step of bringing into contact a sample to be tested with at least one nucleic acid sequence as described herein. Suitably, the sample is a biological sample, such as a tissue sample or a sample of blood or saliva obtained from a subject to be tested. Such samples may be pre-treated before being used in the methods of the invention. Thus, for example, a sample may be treated to extract DNA. Then, DNA probes based on the nucleic acid sequences described herein (ie usually fragments of such sequences) may be used to detect nucleic acid from *S.pneumoniae*.

In additional aspects, the present invention provides:
 (a) a method of vaccinating a subject against *S.pneumoniae* which comprises the step of administering to a subject a protein or polypeptide of the invention, or a derivative, homologue or fragment thereof, or an immunogenic composition of the invention;
 (b) a method of vaccinating a subject against *S.pneumoniae* which comprises the step of administering to a subject a nucleic acid molecule as defined herein;
 (c) a method for the prophylaxis or treatment of *S.pneumoniae* infection which comprises the step of administering to a subject a protein or polypeptide of the invention, or a derivative, homologue or fragment thereof, or an immunogenic composition of the invention;
 (d) a method for the prophylaxis or treatment of *S.pneumoniae* infection which comprises the step of administering to a subject a nucleic acid molecule as defined herein;

(e) a kit for use in detecting/diagnosing *S.pneumoniae* infection comprising one or more proteins or polypeptides of the invention, or homologues, derivatives or fragments thereof, or an antigenic composition of the invention; and (f) a kit for use in detecting/diagnosing *S.pneumoniae* infection comprising one or more nucleic acid molecules as defined herein.

Given that we have identified a group of important proteins, such proteins are potential targets for anti-microbial therapy. It is necessary, however, to determine whether each individual protein is essential for the organism's viability. Thus, the present invention also provides a method of determining whether a protein or polypeptide as described herein represents a potential anti-microbial target which comprises inactivating said protein and determining whether *S.pneumoniae* is still viable, in vitro or in vivo.

A suitable method for inactivating the protein is to effect selected gene knockouts, ie prevent expression of the protein and determine whether this results in a lethal change. Suitable methods for carrying out such gene knockouts are described in Li et al, *P.N.A.S.*, 94:13251–13256 (1997).

In a final aspect the present invention provides the use of an agent capable of antagonising, inhibiting or otherwise interfering with the function or expression of a protein or polypeptide of the invention in the manufacture of a medicament for use in the treatment or prophylaxis of *S.pneumoniae* infection.

The invention will now be described with reference to the following examples, which should not be construed as in any way limiting the invention. The examples refer to the figures in which:

FIG. 1: shows the results of various DNA vaccine trials; and

FIG. 2: shows the results of further DNA vaccine trials.

EXAMPLE 1

The Genome sequencing of *Streptococcus pneumoniae* type 4 is in progress at the Institute for Genomic Research (TIGR, Rockville, Md., USA). Up to now, the whole sequence has not been completed or published. On Nov. 21, 1997, the TIGR centre released some DNA sequences as contigs which are not accurate reflections of the finished sequence. These contigs can be downloaded from their Webster (www@tigr.org). We downloaded these contigs and created a local database using the application GCGTo-BLAST (Wisconsin Package Version 9.1, Genetics Computer Group (GCG), Madison, USA). This database can be searched with the FastA and TfastA procedures (using the method of Pearson and Lipman (*PNAS USA*, 85:2444–2448 (1988)).

Using FastA and TfastA procedures, the local pneumococcus database was searched for putative leader sequence or anchor sequence features. Relevant sequences were used to interrogate for comparative novel sequences. These were:

(i) already described leader sequences of *Streptococcus pneumoniae* (from proteins NanA, NanB, LytA, PapA, pcpA, PsaA and PspA);

(ii) the leader sequence of Usp45, a secreted protein from *Lactococcus lactis*;

(iii) new hypothetical leader sequences derived from the searches in (i) and (ii);

(iv) the anchor motif LPxTG, a feature common to many Gram-positive bacteria surface proteins which are anchored by a mechanism involving the Sortase complex proteins.

Provided below is an example of this approach, with reference to the sequences derived from the database (see table 1).

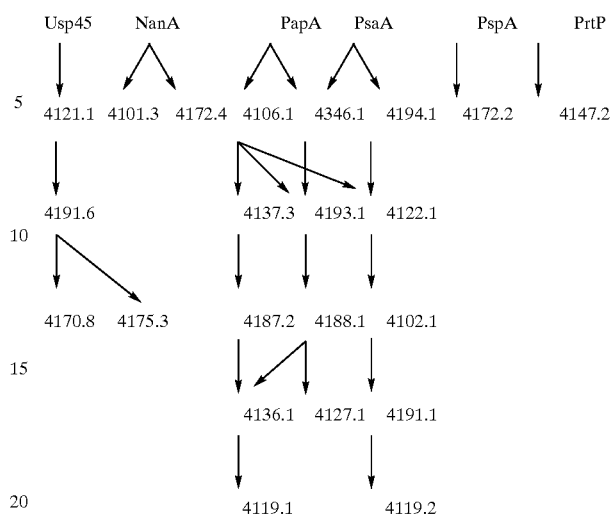

The protein leader sequences of different known exported proteins were used as a starting point for a search of the local pneumococcus database described above. The hypothetical proteins found with this search were then submitted to a Blast search in general databases such as EMBL, Swissprot etc. Proteins remaining unknown in the pneumococcus are kept and annotated. Then the search is performed again using the new potential protein leader sequence as a probe, using the TfastA procedure.

EXAMPLE 2

DNA Vaccine Trials pcDNA3.1+ as a DNA Vaccine Vector

RcDNA3.1+

The vector chosen for use as a DNA vaccine vector was pcDNA3.1 (Invitrogen) (actually pcDNA3.1+, the forward orientation was used in all cases but may be referred to as pcDNA3.1 here on). This vector has been widely and successfully employed as a host vector to test vaccine candidate genes to give protection against pathogens in the literature (Zhang, et al., Kurar and Splitter, Anderson et al.). The vector was designed for high-level stable and non-replicative transient expression in mammalian cells. pcDNA3.1 contains the ColE1 origin of replication which allows convenient high-copy number replication and growth in *E. coli*. This in turn allows rapid and efficient cloning and testing of many genes. The pcDNA3.1 vector has a large number of cloning sites and also contains the gene encoding ampicillin resistance to aid in cloning selection and the human cytomegalovirus (CMV) immediate-early promoter/enhancer which permits efficient, high-level expression of the recombinant protein. The CMV promoter is a strong viral promoter in a wide range of cell types including both muscle and immune (antigen presenting) cells. This is important for optimal immune response as it remains unknown as to which cells types are most important in generating a protective response in vivo. A T7 promoter upstream of the multiple cloning site affords efficient expression of the modified insert of interest and which allows in vitro transcription of a cloned gene in the sense orientation.

Zhang, D., Yang, X., Berry, J. Shen, C., McClarty, G. and Brunham, R. C. (1997) "DNA vaccination with the major outer-membrane protein genes induces acquired immunity to *Chlamydia trachomatis* (mouse pneumonitis) infection". *Infection and Immunity*, 176, 1035–40.

Kurar, E. and Splitter, G. A. (1997) "Nucleic acid vaccination of *Brucella abortus* ribosomal L7/L12 gene elicits immune response". *Vaccine*, 15, 1851–57.

Anderson, R., Gao, X.-M., Papakonstantinopoulou, A., Roberts, M. and Dougan, G. (1996) "Immune response in mice following immunisation with DNA encoding fragment C of tetanus toxin". *Infection and Immunity*, 64, 3168–3173.

Preparation of DNA Vaccines

Oligonucleotide primers were designed for each individual gene of interest derived using the LEEP system. Each gene was examined thoroughly, and where possible, primers were designed such that they targeted that portion of the gene thought to encode only the mature portion of the gene protein. It was hoped that expressing those sequences that encode only the mature portion of a target gene protein, would facilitate its correct folding when expressed in mammalian cells. For example, in the majority of cases primers were designed such that putative N-terminal signal peptide sequences would not be included in the final amplification product to be cloned into the pcDNA3.1 expression vector. The signal peptide directs the polypeptide precursor to the cell membrane via the protein export pathway where it is normally cleaved off by signal peptidase I (or signal peptidase II if a lipoprotein). Hence the signal peptide does not make up any part of the mature protein whether it be displayed on the surface of the bacteria surface or secreted. Where a N-terminal leader peptide sequence was not immediately obvious, primers were designed to target the whole of the gene sequence for cloning and ultimately, expression in pcDNA3.1.

Having said that, however, other additional features of proteins may also affect the expression and presentation of a soluble protein. DNA sequences encoding such features in the genes encoding the proteins of interest were excluded during the design of oligonucleotides. These features included:
1. LPXTG cell wall anchoring motifs.
2. LXXC ipoprotein attachment sites.
3. Hydrophobic C-terminal domain.
4. Where no N-terminal signal peptide or LXXC was present the start codon was excluded.
5. Where no hydrophobic C-terminal domain or LPXTG motif was present the stop codon was removed.

Appropriate PCR primers were designed for each gene of interest and any and all of the regions encoding the above features was removed from the gene when designing these primers. The primers were designed with the appropriate enzyme restriction site followed by a conserved Kozak nucleotide sequence (in all cases) GCCACC was used. The Kozak sequence facilitates the recognition of initiator sequences by eukaryotic ribosomes) and an ATG start codon upstream of the insert of the gene of interest. For example the forward primer using a BamHI site the primer would begin GCGGGATCCGCCACCATG followed by a small section of the 5' end of the gene of interest. The reverse primer was designed to be compatible with the forward primer and with a NotI restriction site at the 5' end in all cases (this site is TTGCGGCCGC).

PCR Primers

The following PCR primers were designed and used to amplify the truncated genes of interest.

ID210

Forward Primer 5' CGGATCCGCCACCATGTCTTCTAAT-GAATCTGCCGATG 3'
Reverse Primer 5' TTGCGGCCGCCTGTTTAGATTG-GATATCTGTAAAGACTT 3'

4172.5

Forward Primer 5' CGCGGATCCGCCACCATG-GATTTTCCTTCAAATTTGGAGG 3'
Reverse Primer 5' TTGCGGCCGCACCGTACTGGCT-GCTGACT 3'

ID211

Forward Primer 5' CGGATCCGCCACCATGAGTGAGAT-CAAAATTATTAACGC3'
Reverse Primer 5' TTGCGGCCGCCGTTCCATGGT-TGACTCCT 3'

4197.4

Forward Primer 5' CGCGGATCCGCCACCATGTGGGA-CATATTGGTGGAAAC 3'
Reverse Primer 5' TTGCGGCCGCTTCACTTGAG-CAAACTGAATCC 3'

4122.1

Forward Primer 5' CGCGGATCCGCCACCATGTCACAA-GAAAAAACAAAAAATGAA 3'
Reverse Primer 5' TTGCGGCCGCATCGACGTAGTCTC-CGCC 3'

4126.7

Forward Primer 5' CGCGGATCCGCCACCATGCTGGT-TGGAACTTTCTACTATCAAT 3'
Reverse Primer 5' TTGCGGCCGCAACTTTCGTC-CCTTTTTGG 3'

4188.11

Forward Primer 5' CGCGGATCCGCCACCATGGGCAAT-TCTGGCGGAA 3'
Reverse Primer 5' TTGCGGCCGCTTGTTTCAT-AGCTTTTTTGATTGTT 3'

ID209

Forward Primer 5' CGCGGATCCGCCACCATGCTAT-TGATACGAAATGCAGGG 3'
Reverse Primer 5' TTGCGGCCGCAACATAATCTAG-TAAATAAGCGTAGCC 3'

ID215

Forward Primer 5' CGCGGATCCGCCACCATGACGGC-GACGAATTTTC 3'
Reverse Primer 5' TTGCGGCCGCTTAAT-TCGTTTTTGAACTAGTTGCT 3'

4170.4

Forward Primer 5' CGCGGATCCGCCACCATGGCT-GTTTTTCTTCGCTATCATG 3'
Reverse Primer 5' TTGCGGCCGCTTTCTTCAACAAAC-CTTGTTCTTG 3'

4193.1

Forward Primer 5' CGCGGATCCGCCACCATGGGTAAC-CGCTCTTCTCGTAAC 3'
Reverse Primer 5' TTGCGGCCGCGCTTCCATCAAG-GATTTTAGC 3'

Cloning

The insert along with the flanking features described above was amplified using PCR against a template of genomic DNA isolated from type 4 *S.pneumoniae* strain 11886 obtained from the National Collection of Type Cultures. The PCR product was cut with the appropriate restriction enzymes and cloned in to the multiple cloning site of pcDNA3.1 using conventional molecular biological techniques. Suitably mapped clones of the genes of interested were cultured and the plasmids isolated on a large scale (>1.5 mg) using Plasmid Mega Kits (Qiagen). Successful cloning and maintenance of genes was confirmed by restriction mapping and sequencing ~700 base pairs through the 5' cloning junction of each large scale preparation of each construct.

Strain Validation

A strain of type 4 was used in cloning and challenge methods which is the strain from which the *S.pneumoniae* genome was sequenced. A freeze dried ampoule of a homogeneous laboratory strain of type 4 *S.pneumoniae* strain NCTC 11886 was obtained from the National Collection of Type Strains. The ampoule was opened and the cultured re suspended with 0.5 ml of tryptic soy broth (0.5% glucose, 5% blood). The suspension was subcultured into 10 ml tryptic soy broth (0.5% glucose, 5% blood) and incubated statically overnight at 37° C. This culture was streaked on to 5% blood agar plates to check for contaminants and confirm viability and on to blood agar slopes and the rest of the culture was used to make 20% glycerol stocks. The slopes were sent to the Public Health Laboratory Service where the type 4 serotype was confirmed.

A glycerol stock of NCTC 11886 was streaked on a 5% blood agar plate and incubated overnight in a CO2 gas jar at 37° C. Fresh streaks were made and optochin sensitivity was confirmed.

Pneumococcal Challenge

A standard inoculum of type 4 *S.pneumoniae* was prepared and frozen down by passaging a culture of pneumococcus 1× through mice, harvesting from the blood of infected animals, and grown up to a predetermined viable count of around $10^9$ cfu/ml in broth before freezing down. The preparation is set out below as per the flow chart.

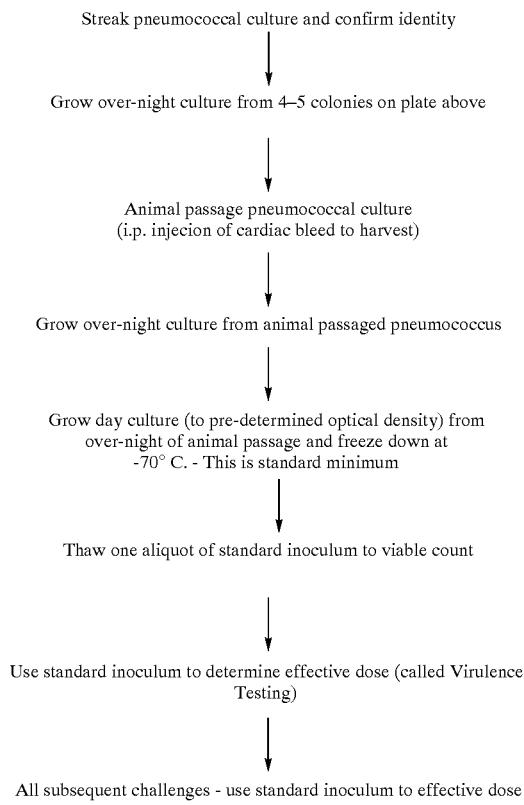

An aliquot of standard inoculum was diluted 500× in PBS and used to inoculate the mice.

Mice were lightly anaesthetised using halothane and then a dose of $1.4 \times 10^5$ cfu of pneumococcus was applied to the nose of each mouse. The uptake was facilitated by the normal breathing of the mouse, which was left to recover on its back.

S. pneumoniae Vaccine Trials

Vaccine trials in mice were carried out by the administration of DNA to 6 week old CBA/ca mice (Harlan, UK). Mice to be vaccinated were divided into groups of six and each group was immunised with recombinant pcDNA3.1+ plasmid DNA containing a specific target-gene sequence of interest. A total of 100 µg of DNA in Dulbecco's PES (Sigma) was injected intramuscularly into the tibialis anterior muscle of both legs (50 µl in each leg). A boost was carried using the same procedure 4 weeks later. For comparison, control groups were included in all vaccine trials. These control groups were either unvaccinated animals or those administered with non-recombinant pcDNA3.1+ DNA (sham vaccinated) only, using the same time course described above. 3 weeks after the second immunisation, all mice groups were challenged intra-nasally with a lethal dose of *S. pneumoniae* serotype 4 (strain NCTC 11886). The number of bacteria administered was monitored by plating serial dilutions of the inoculum on 5% blood agar plates. A problem with intranasal immunisations is that in some mice the inoculum bubbles out of the nostrils, this has been noted in results table and taken account of in calculations. A less obvious problem is that a certain amount of the inoculum for each mouse may be swallowed. It is assumed that this amount will be the same for each mouse and will average out over the course of innoculations. However, the sample sizes that have been used are small and this problem may have significant effects in some experiments. All mice remaining after the challenge were killed 3 or 4 days after infection. During the infection process, challenged mice were monitored for the development of symptoms associated with the onset of *S.pneumoniae* induced-disease. Typical symptoms in an appropriate order included piloerection, an increasingly hunched posture, discharge from eyes, increased lethargy and reluctance to move. The latter symptoms usually coincided with the development of a moribund state at which stage the mice were culled to prevent further suffering. These mice were deemed to be very close to death, and the time of culling was used to determine a survival time for statistical analysis. Where mice were found dead, the survival time was taken as the last time point when the mouse was monitored alive.

Interpretation of Results

A positive result was taken as any DNA sequence that was cloned and used in challenge experiments as described above which gave protection against that challenge. Protection was taken as those DNA sequences that gave statistically significant protection (to a 95% confidence level (p<0.05)) and also those which were marginal or close to significant using Mann-Whitney or which show some protective features for example there were one or more outlying mice or because the time to the first death was prolonged. It is acceptable to allow marginal or non-significant results to be considered as potential positives when it is considered that the clarity of some of the results may be clouded by the problems associated with the administration of intranasal infections.

Results for vaccine trials 2, 7 and 8 (see FIG. 1)

| | | | | | Mean survival time (hours) | | | | |
|---|---|---|---|---|---|---|---|---|---|
| Mouse number | Unvacc control (2) | ID210 (2) | Unvacc control (7) | 4172.5 (7) | Unvacc control | ID211 (8) | 4197.4 (8) | 4122.1 (8) | 4126.7 (8) |
| 1 | 49.0 | 55.0 | 59.6 | 72.6 | 45.1 | 102.3T | 60.1 | 50.6 | 60.0 |
| 2 | 51.0 | 46.5 | 47.2 | 67.9 | 50.8 | 55.5 | 54.9 | 77.2 | 60.0 |
| 3 | 49.0 | 49.0 | 59.6 | 54.4 | 60.4 | 60.6* | 68.4 | 60.3 | 54.8 |
| 4 | 55.0 | 59.0 | 70.9 | 75.3 | 55.2 | 45.3 | 60.1 | 50.6 | 52.6 |
| 5 | 49.0 | 55.0 | 68.6* | 70.9 | 45.1 | 55.5 | 54.9 | 50.6* | 54.8 |
| 6 | 49.0 | 49.0 | 76.0 | 75.3 | 45.1 | 102.3T | 52.7 | 44.9 | 60 |
| Mean | 50.3 | 52.3 | 63.6 | 69.4 | 50.2 | 70.2 | 58.5 | 55.7 | 57.0 |
| sd | 2.4 | 4.8 | 10.3 | 7.9 | 6.4 | 25.3 | 5.7 | 11.6 | 3.4 |
| p value 1 | — | 0.3333 | — | 0.2104 | — | 0.0215 | 0.0621 | 0.4038 | 0.0833 |

*bubbled when dosed so may not have received full inoculum.
Tterminated at end of experiment having no symptoms of infection.
Numbers in brackets - survival times disregarded assuming incomplete dosing
p value 1 refers to significance tests compared to unvaccinated controls
Statislical Analyses.
Trial 2 - The group vaccinated with ID210 also had a longer mean survival time than the unvaccinated controls but the results are not statistically significant.
Trial 7 - The group vaccinated with 4172.5 showed much greater survival times than unvaccinated controls although the differences were not statistically significant.
Trial 8 - The group vaccinated with ID211 survived significantly longer than unvaccinated controls. 4197.4, 4122.1 and 4126.7 vaccinated groups showed longer mean survival times than the unvaccinated group but the results were not statistically significant. The 4197.4 and 4126.7 groups also showed a prolonged time to the first death and the 4122.1 group showed 1 outlying result.

Results of pneumococcal challenge DNA vaccination trials 9–11 (see FIG. 2)

| | | | | | Mean survival times (hours) | | | | | |
|---|---|---|---|---|---|---|---|---|---|---|
| Mouse number | Unvacc control (9) | 4188.11 (9) | ID209 (9) | Unvacc control (10) | pcDNA3.1 + (10) | ID215 (10) | 4170.4 (10) | Unvacc control (11) | pcDNA3.1 + (11) | 4193.1 (11) |
| 1 | (98.5)T | 69.4 | 60.2 | 68.4 | 58.6 | 79.2 | 68.1 | 60.0 | 53.2 | 54.8 |
| 2 | 53.4 | 53.7 | 60.2 | 59.0 | 58.6 | 54.2 | 58.6 | 50.0 | 50.4 | 54.8 |
| 3 | 53.4 | 51.2 | 60.2 | 59.0 | 50.8 | (103.2)*T | 50.9 | 60.0 | 55.4 | 68.7* |
| 4 | 53.4 | 75.0 | (98.0)*T | 45.1* | 58.6 | 58.8 | 72.1 | 55.0 | 60.6 | 54.8 |
| 5 | 70.8 | 51.2 | 60.2 | 68.4 | 46.5 | 68.3 | 68.1 | 60.0 | 50.4 | 68.7 |
| 6 | 53.4 | 61.2 | 52.9 | 59.0 | 48.9 | 58.8 | 54.0 | 50.0 | 60.6 | 68.7* |
| Mean | 56.9 | 60.3 | 58.8 | 59.8 | 53.6 | 63.9 | 62.0 | 55.8 | 55.1 | 61.7 |
| Sd | 7.8 | 10.0 | 3.3 | 8.5 | 5.6 | 10.0 | 8.7 | 5.0 | 4.6 | 7.6 |
| p value 1 | — | 0.3894 | 0.2519 | — | 0.0307 | <30.0 | <39.0 | — | — | 0.1837 |
| p value 2 | — | — | — | — | — | 0.0168 | 0.0316 | — | — | 0.0829 |

*bubbled when dosed so may not have received full inoculum.
Tterminated at end or experiment having no symptoms of infection.
Numbers in brackets - survival times disregarded assuming incomplete dosing
p value 1 refers to significance tests compared to unvaccinated controls
p value 2 refers to significance tests compared to pcDNA3.1 + vaccinated controls
Statistical Analyses.
Trial 9 - Although not statistically significant the groups vaccinated with 4188.11 and ID209 did have noticeably higher mean survival times than unvaccinated controls.
Trial 10 - The unvaccinated control group survived for a significantly longer period than the pcDNA3.1 + vaccinated group. The groups vaccinated with ID215 and 4170.4 showed statistically significant longer survival times compared to the sham vaccinated group (p = 0.0168 and 0.0316) but not compared to the unvaccinated group.
Trial 11 - The group vaccinated with 4193.1 was the most promising and survived an average of 6.5 hours longer than the pcDNA3.1 + vaccinated group and 6 hours longer than the unvaccinated group although the results were not statistically significant.

TABLE 1

4101.1 (SEQ. ID. NO. 208)
ATGGAAGAGTTAGTGACCTTAGATTGTTTGTTTATTGACAGAACTAAGATTGAAGCCAATGCCAACAAGTATAGTT
TTGTGTGGAAGAAAACGACAGAGAAATTCTCCGCCAAACTTCAAGAACAGATACAGGTCTATTTTCAAGAAGAAA
TCACTCCCCTTCTGATTAAATATGCCATGTTTGATAAGAAACAAAAGAGAGGGTATAAAGAGTCAGCTAAAAACT
TAGCGAATTGGCACTATAATGACAAGGAGGATAGCTACACACATCCTGATGGCTGGTATTATCGTTTTCACCATAC

TABLE 1-continued

```
CAAATATCAGAAAACACAGACAGACTTTCAACAAGAAATCAAGGTTTACTACGCCGACGAACCTGAATCAGCCCC
TCAAAAGGGACTGTATATGAACAACGCTATCAAAACTTGAAAGCTAAAGAATGTCAGGCGCTTTTATCTCCCCA
AGGTAGACAGATTTTCGCTCAACGCAAGATTGATGTGGAACCTGTCTTTGGGCAGATAAAGGCTTCTTTGGGTTAC
AAGAGATGTAATCTGAGAGGGAAGCGTCAAGTGAGAATTGACATGGGATTGGTACTTATGGCCAATAACCTCCTA
AAATATAGTAAAATGAAATAA
```

4101.3 (SEQ. ID. NO. 209)

```
ATGGGGAAAGGCCATTGGAATCGGAAAAGAGTTTATAGCATTCGTAAGTTTGCTGTGGGAGCTTGCTCAGTAATG
ATTGGGACTTGTGCAGTTTTATTAGGAGGAAATATAGCTGGAGAATCTGTAGTTTATGCGGATGAAACACTTATTA
CTCATACTGCTGAGAAACCTAAAGAGGAAAAAATGATAGTAGAAGAAAAGGCTGATAAAGCTTTGGAAACTAAA
AATATAGTTGAAAGGACAGAACAAAGTGAACCTAGTTCAACTGAGGCTATTGCATCTGAGAAGAAAGAAGATGAA
GCCGTAACTCCAAAAGAGGAAAAAGTGTCTGCTAAACCGGAAGAAAAAGCTCCAAGGATAGAATCACAAGCTTC
AAATCAAGAAAAACCGCTCAAGGAAGATGCTAAAGCTGTAACAAATGAAGAAGTGAATCAAATGATTGAAGACA
GGAAAGTGGATTTTAATCAAAATTGGTACTTTAAACTCAATGCAAATTCTAAGGAAGCCATTAAACCTGATGCAG
ACGTATCTACGTGGAAAAAATTAGATTTACCGTATGACTGGAGTATCTTTAACGATTTCGATCATGAATCTCCTGC
ACAAAATGAAGGTGGACAGCTCAACGGTGGGGAAGCTTGGTATCGCAAGACTTTCAAACTAGATGAAAAAGACCT
CAAGAAAAATGTTCGCCTTACTTTTGATGGCGTCTACATGGATTCTCAAGTTTATGTCAATGGTCAGTTAGTGGGG
CATTATCCAAATGGTTATAACCAGTTCTCATATGATATCACCAAATACCTTCAAAAAGATGGTCGTGAGAATGTGA
TTGCTGTCCATGCAGTCAACAAACAGCCAAGTAGCCGTTGGTATTCAGGAAGTGGTATCTATCGTGATGTGACTTT
ACAAGTGACAGATAAGGTGCATGTTGAGAAAAATGGGACAACTATTTTAACACCAAAACTTGAAGAACAACAACA
TGGCAAGGTTGAAACTCATGTGACCAGCAAAATCGTCAATACGGACGACAAAGACCATGAACTTGTAGCCGAATA
TCAAATCGTTGAACGAGGTGGTCATGCTGTAACAGGCTTAGTTCGTACAGCGAGTCGTACCTTAAAAGCACATGA
ATCAACAAGCCTAGATGCGATTTTAGAAGTTGAAAGACCAAAACTCTGGACTGTTTTAAATGACAAACCTGCCTTG
TACGAATTGATTACGCGTGTTTACCGTGACGGTCAATTGGTTCATGCTAAGAAGGATTTGTTTGGTTACCGTTACT
ATCACTGGACTCCAAATGAAGGTTTCTCTTTGAATGGTGAACGTATTAAATTCCATGGAGTATCCTTGCACCACGA
CCATGGGGCGCTTGGAGCAGAAGAAAACTATAAAGCAGAATATCGCCGTCTCAAACAAATGAAGGAGATGGGAG
TTAACTCCATCCGTACAACCCACAACCCTGCTAGTGAGCAAACCTTGCAAATCGCAGCAGAACTAGGTTTACTCGT
TCAGGAAGAGGCCTTTGATACGTGGTATGGTGGCAAGAAACCTTATGACTATGGACGTTTCTTTGAAAAAGATGC
CACTCACCCAGAAGCTCGAAAAGGTGAAAAATGGTCTGATTTTGACCTACGTACCATGGTCGAAAGAGGCAAAAA
CAACCCTGCTATCTTCATGTGGTCAATTGGTAATGAAATAGGTGAAGCTAATGGTGATGCCCACTCTTTAGCAACT
GTTAAACGTTTGGTTAAGGTTATCAAGGATGTTGATAAGACTCGCTATGTTACCATGGGAGCAGATAAATTCCGTT
TCGGTAATGGTAGCGGAGGGCATGAGAAAATTGCTGATGAACTCGATGCTGTTGGATTTAACTATTCTGAAGATA
ATTACAAAGCCCTTAGAGCTAAGCATCCAAATGGTTGATTTATGGATCAGAAACATCTTCAGCTACCCGTACACG
TGGAAGTTACTATCGCCCTGAACGTGAATTGAAACATAGCAATGGACCTGAGCGTAATTATGAACAGTCAGATTA
TGGAAATGATCGTGTGGGTTGGGGGAAAACAGCAACCGCTTCATGGACTTTTGACCGTGACAACGCTGGCTATGC
TGGACAGTTTATCTGGACAGGTACGGACTATATTGGTGAACCTACACCATGGCACAACCAAAATCAAACTCCTGTT
AAGAGCTCTTACTTTGGTATCGTAGATACAGCCGGCATTCCAAAACATGACTTCTATCTCTACCAAAGCCAATGGG
TTTCTGTTAAGAAGAAACCGATGGTACACCTTCTTCCTCACTGGAACTGGGAAAACAAAGAATTAGCATCCAAAG
TAGCTGACTCAGAAGGTAAGATTCCAGTTCGTGCTTATTCGAATGCTTCTAGTGTAGAATTGTTCTTGAATGGAAA
ATCTCTTGGTCTTAAGACTTTCAATAAAAACAAACCAGCGATGGGCGGACTTACCAAGAAGGTGCAAATGCTAA
TGAACTTTATCTTGAATGGAAAGTTGCCTATCAACCAGGTACCTTGGAAGCAATTGCTCGTGATGAATCTGGCAAG
GAAATTGCTCGAGATAAGATTACGACTGCTGGTAAGCCAGCGGCAGTTCGTCTTATTAAGGAAGACCATGCGATT
GCAGCAGATGGAAAAGACTTGACTTACATCTACTATGAATTGTTGACAGCCAGGGGAATGTGGTTCCAACTGCT
AATAATCTGGTTCGCTTCCAATTGCATGGCCAAGGTCAACTGGTCGGTGTAGATAACGGAGAACAAGCCAGCCGT
GAACGCTATAAGGCGCAAGCAGATGGTTCTTGGATTCGTAAAGCATTTAATGGTAAAGGTGTTGCCATTGTCAAAT
CAACTGAACAAGCAGGGAAATTCACCCTGACTGCCCACTCTGATCTCTTGAAATCGAACCAAGTCACTGTCTTTAC
TGGTAAGAAAGAAGGACAAGAGAAGACTGTTTTGGGGACAGAAGTGCCAAAAGTACAGACCATTATTGGAGAGG
CACCTGAAATGCCTACCACTGTTCCGTTTGTATACAGTGATGGTAGCCGTGCAGAACGTCCTGTAACCTGGTCTTC
AGTAGATGTGAGCAAGCCTGGTATTGTAACGGTGAAAGGTATGGCTGACGGACAGAAGTAGAAGCTCGTGTAGA
AGTGATTGCTCTTAAATCAGAGCTACCAGTTGTGAAACGTATTGCTCCAAATACTGACTTGAATTCTGTAGACAAA
TCTGTTTCCTATGTTTTGATTGATGGAAGTGTTGAAGAGTATGAAGTGGACAAGTGGGAGATTGCCGAAGAAGATA
AAGCTAAGTTAGCAATTCCAGGTTCTCGTATTCAAGCGACCGGTTATTTAGAAGGTCAACCAATTCATGCAACCCT
TGTGGTAGAAGAAGGCAATCCTGCGGCACCTGCAGTACCAACTGTAACGGTTGGTGGTGAGGCAGTAACAGGTCT
TACTAGTCAAAAACCAATGCAATACCGCACTCTTGCTTATGGAGCTAAGTTGCCAGAAGTCACAGCAAGTGCTAA
AAATGCAGCTGTTACAGTTCTTCAAGCAAGCGCAGCAAACGGCATGCGTGCGAGCATCTTTATTCAGCCTAAAGA
TGGTGGCCCTCTTCAAACCTATGCAATTCAATTCCTTGAAGAAGCGCCAAAAATTGCTCACTTGAGCTTGCAAGTG
GAAAAAGCTGACAGTCTCAAAGAAGACCAAACTGTCAAATTGTCGGTTCGAGCTCACTATCAAGATGGAACGCAA
GCTGTATTACCAGCTGATAAAGTAACCTTCTCTACAAGTGGTGAAGGGAAGTCGCAATTCGTAAAGGAATGCTT
GAGTTGCATAAGCCAGGAGCAGTCACTCTGAACGCTGAATATGAGGGAGCTAAAGACCAAGTTGAACTCACTATC
CAAGCCAATACTGAGAAGAAGATTGCGCAATCCATCCGTCCTGTAAATGTAGTGACCAGATTTGCATCAGGAACCA
AGTCTTCCAGCAACAGTAACAGTTGAGTATGACAAAGGTTTCCCTAAAACTCATAAAGTCACTTGGCAAGCTATTC
CGAAAGAAAAACTAGACTCCTATCAAACATTTGAAGTACTAGGTAAAGTTGAAGGAATTGACCTTGAAGCGCGTG
CAAAAGTCTCTGTAGAAGGTATCGTTTCAGTTGAAGAAGTCAGTGTGACAACTCCAATCGCAGAAGCACCACAAT
TACCAGAAAGTGTTCGGACATATGATTCAAATGGTCACGTTTCATCAGCTAAGGTTGCATGGGATGCGATTCGTCC
AGAGCAATACGCTAAGGAAGGTGTCTTTACAGTTAATGGTCGCTTAGAAGGTACGCAATTAACAACTAAACTTCA
TGTTCGCGTATCTGCTCAAACTGAGCAAGGTGCAAACATTTCTGACCAATGGACCGGTTCAGAATTGCCACTTGCC
TTTGCTTCAGACTCAAATCCAAGCGACCCAGTTTCAAATGTTAATGACAAGCTCATTTCCTACAATAACCAACCAG
CCAATCGTTGGACAAACTGGAATCGTACTAATCCAGAAGCTTCAGTCGGTGTTCGTTTGGAGATTCAGGTATCTT
GAGCAAACGCTCCGTTGATAATCTAAGTGTCGGATTCCATGAAGACCATGGAGTTGGTGTACCGAAGTCTTATGTG
ATTGAGTATTATGTTGGTAAGACTGTCCCAACAGCTCCTAAAAACCCTAGTTTTGTTGGTAATGAGGACCATGTCT
TTAATGATTCTGCCAACTGGAAACCAGTTACTAATCTAAAAGCCCCTGCTCAACTCAAGGCTGGAGAAATGAACC
ACTTTAGCTTTGATAAAGTTGAAACCTATGCTGTTCGTATTCGCATGGTTAAAGCAGATAACAAGCGTGGAACGTC
TATCACAGAGGTACAAATCTTTGCGAAACAAGTTGCGGCAGCCAAGCAAGGACAAACAAGAATCCAAGTTGACGG
CAAAGACTTAGCAAACTTCAACCCTGATTTGACAGACTAACTACCTTGAGTCTGTAGATGGAAAAGTTCCGGCAGTC
ACAGCAAGTGTTAGCAACAATGGTCTCGCTACCGTCGTTCCAAGCGTTCGTGAAGGTGAGCCAGTTCGTGTCATCG
CGAAAGCTGAAAATGGCGACATCTTAGGAGAATACCGTCTGCACTTCACTAAGGATAAGAGCTTACTTTCTCATA
AACCAGTTGCTGCGGTTAAACAAGCTCGCTTGCTACAAGTAGGTCAAGCACTTGAATTGCCGACTAAGGTTCCAGT
TTACTTCACAGGTAAAGACGGCTACGAAACAAAAGACCTGACAGTTGAATGGGAAGAAGTTCCAGCGGAAAATCT
GACAAAAGCAGGTCAATTTACTGTTCGAGGCCGTGTCCTTGGTAGTAACCTTGTTGCTGAGATCACTGTACGAGTG
```

TABLE 1-continued

ACAGACAAACTTGGTGAGACTCTTTCAGATAACCCTAACTATGATGAAAACAGTAACCAGGCCTTTGCTTCAGCA
ACCAATGATATTGACAAAAACTCTCATGACCGCGTTGACTATCTCAATGACGGAGATCATTCAGAAAATCGTCGTT
GGACAAACTGGTCACCAACACCATCTTCTAATCCAGAAGTATCAGCGGGTGTGATTTTCCGTGAAAATGGTAAGA
TTGTAGAACGGACTGTTACACAAGGAAAAGTTCAGTTCTTTGCAGATAGTGGTACGGATGCACCATCTAAACTCGT
TTTAGAACGCTATGTCGGTCCAGAGTTTGAAGTGCCAACCTACTATTCAAACTACCAAGCCTACGACGCAGACCAT
CCATTCAACAATCCAGAAAATTGGGAAGCTGTTCCTTATCGTGCGGATAAAGACATTGCAGCTGGTGATGAAATC
AACGTAACATTTAAAGCTATCAAAGCCAAAGCTATGAGATGGCGTATGGAGCGTAAAGCAGATAAGAGCGGTGTT
GCGATGATTGAGATGACCTTCCTTGCACCAAGTGAATTGCCTCAAGAAAGCACTCAATCAAAGATTCTTGTAGATG
GAAAAGAACTTGCTGATTTCGCTGAAAATCGTCAAGACTATCAAATTACCTATAAAGGTCAACGGCCAAAAGTCT
CAGTTGAAGAAAACAATCAAGTAGCTTCAACTGTGGTAGATAGTGGAGAAGATAGCTTTCCAGTACTTGTTCGCCT
CGTTTCAGAAAGTGGAAAACAAGTCAAGGAATACCGTATCCACTTGACTAAGGAA
AAACCAGTTTCTGAGAAGACAGTTGCTGCTGTACAAGAAGATCTTCCAAAAATCGAATTTGTTGAAAAAGATTTG
GCATACAAGACAGTTGAGAAAAAAGATTCAACACTGTATCTAGGTGAAACTCGTGTAGAACAAGAAGGAAAAGTT
GGAAAAGAACGTATCTTTACAGCGATTAATCCTGATGGAAGTAAGGAAGAAAAACTCCGTGAAGTGGTAGAAGTT
CCGACAGACCGCATCGTCTTGGTTGGAACCAAACCAGTAGCTCAAGAAGCTAAAAAACCACAAGTGTCAGAAAAA
GCAGATACAAAACCAATTGATTCAAGTGAAGCTAGTCAAACTAATAAAGCCCAGTTACCAAGTACAGGTAGTGCG
GCAAGCCAAGCAGCAGTAGCAGCAGGTTTAACTCTTCTAGGTTTGAGTGCAGGATTAGTAGTTACTAAAGGTAAA
AAAGAAGACTAG 4101.5                                                                     (SEQ. ID. NO. 210)
ATGGATGCAATCTTTGACCTAATCGGAAAGGTTTTCAATCCCATCTTAGAAATGGGTGGACCTGTCATCATGTTAA
TCATTTTGACAGTATTGGCTTTACTTTTTGGAGTGAAATTCTCCAAAGCGCTTGAAGGTGGTATCAAACTTGCCAT
CGCTCTTACAGGTATCGGTGCTATCATCGGTATGCTAAACACTGCTTTCTCAGCATCACTAGCAAAATTCGTTGAA
AACACTGGTATCCAATTGAGTATTACCGACGTTGGTTGGGCACCACTTGCTACAATCACTTGGGGTTCTGCTTGGA
CACTATACTTCTTGCTCATCATGTTGATTGTCAACATAGTGATGCTAGCTATGAAGAAAACAGATACATTGATGT
CGATATCTTTGATATCTGGCACTTGTCTATCACAGGTCTCTTGATTAAATGGTATGCTGATAACAATGGTGTGAGT
CAAGGGGTTTCACTCTTTATTGCTACAGCAGCTATCGTCCTTGTCGGTGTGTTGAAAATTATCAACTCTGACTTGAT
GAAACCTACATTTGATGACCTTCTTAACGCCCCAAGTTCATCACCAATGACATCAACTCACATGAACTACATGATG
AACCCAGTTATCATGGTTTTGGATAAGATTTTTGAAAAATTCTTCCCAGGCCTTGATAAATATGACTTTGATGCTG
CTAAATTGAACAAGAAAATCGGTTTCTGGGGATCTAAATTCTTCATCGGTTTCATCCTTGGTATCGTTATCGGTATT
ATGGGAACTCCACATCCAATTGCAGGTGTTGCAGATGCAGATAAATGGCGTCTTGTTATCAAAGGATGGTTGTCTC
TTGGTTTGACTGCCGGTGTATCTTTGGAACTCTTCTCACTTATCGGTTCATGGTTCATCGCAGCCGTAGAACCACTA
TCACAAGGTATTACAAACGTTGCTACTAAACGTCTTCAAGGACGTAAATTCAATATCGGTCTTGACTGGCCATTCA
TCGCTGGTCGTGCTGAAATCTGGGCTTGTGCCAACGTACTTGCACCAATCATGTTGATTGAAGCAGTGCTTCTTTC
AAAAGTTGGAAATGGTATCTTGCCACTTGCAGGTATCATCGCTATGGGTGTTACTCCAGCTCTCTTGGTTGTAACT
CGTGGTAAATTGCTCCGTATGATTATCTTCGGAACACTCTTGTTGCCACTCTTCCTTCTTTCAGGTACACTTATTGC
ACCATTTGCAACAGAACTTGCTAAAGGTGTAGGTGCCTTCCCAGAAGGTGTGAGCCAAACTCAATTGATTACTCAC
TCTACTCTTGAAGGACCAATCGAAAAACTTCTTGGTTGGACAATTGGTAACACTACAACTGGTGATATCAAAGCAA
TCCTTGGTGCAGTAGTCTTCCTTGTATTCTATATCGGTATCTTTGCTTGGTACAGAAAACAAATGATCAAACGTAA
CGAAGAGTACGCAGCAAAAGCAAAATAA 4102.1                                                                     (SEQ. ID. NO. 211)
ATGAAGATTATGAAAAAAAAATATTGGACTTTAGCGATATTATTCTTTTGTTTGTTCAATAATTCTGTTACTGCTCA
AGAAATACCTAAAAATCTTGATGGCAATATAACTCACACTCAGACTAGCGAAAGTTTTTCTGAATCTGATGAAAA
ACAGGTTGACTATTCTAATAAAAATCAAGAAGAAGTAGACCAAAATAAATTTCGTATTCAAATCGATAAGACAGA
ATTATTTGTAACAACAGATAAACATTTAGAAAAAAACTGTTGTAAATTGGACTTGAACCACAAATAAATAACGA
TATTGTTAACTCTGAAAGTAATAATTTACTAGGCGAAGATAATTTAGATAATAAAATTAAGGAAAATGTTTCTCAT
CTAGATAATAGAGGAGGAAATATAGAGCATGACAAAGATAACTTAGAATCGTCGATTGTAAGAAAATATGAATGG
GATATAGATAAAGTTACTGGTGGAGGCGAAAGTTATAAATTATATTCTAAAAGTAATTCTAAAGTTTCAATTGCTA
TTTTAGATTCAGGAGTCGATTTACAAAATACTGGATTACTGAAAAATCTTTCAAATCACTCAAAAAACTATGTCCC
CAATAAAGGATATTTAGGAAAAGAGGAGGGAGAGGAAGGAATAATATCAGATATTCAAGATAGATTAGGTCATG
GTACGGCTGTTGTAGCTCAAATTGTAGGGGATGACAATATTAATGGAGTAAATCCTCACGTTAATATTAACGTCTA
TAGAATATTTGGTAAGTCGTCAGCTAGTCCAGATTGGATTGTAAAAGCAATTTTTGATGCTGTAGATGATGGCAAT
GATATTATCAATCTTAGTACTGGACAATATTTAATGATTGATGGAGAATATGAGGACGGAACAAATGATTTTGAAA
CATTTTTGAAGTATAAAAAGGCTATTGATTACGCGAATCAAAAAGGAGTAATTATAGTAGCTGCATTAGGGAATG
ACTCCCTAAATGTATCAAATCAGTCAGATTTATTGAAACTTATTAGTTCACGCAAAAAGTAAGAAAACCAGGATT
AGTAGTTGATGTTCCAAGTTATTTCTCATCTACAATTTCGGTCGGAGGCATAGATCGCTTAG
GTAATTTATCAGATTTTAGCAATAAAGGGGATTCTGATGCAATATATGCGCCTCAGGCTCAACATTATCTCTTTC
AGAATTAGGACTTAATAACTTTATTAATGCAGAAAAATATAAAGAAGATTGGATTTTTTCGGCAACACTAGGAGG
ATATACGTATCTTTATGGAAACTCATTTGCTGCTCCTAAAGTTTCTGGTGCGATTGCAATGATTATTGATAAATACA
AATTAAAAGATCAGCCCTATAATTATATGTTTGTAAAAAAATTCTGGAAGAAACATTACCAGTAA 4106.1                                                                     (SEQ. ID. NO. 212)
ATGAAGAAAACATGGAAAGTGTTTTTAACGCTTGTAACAGCTCTTGTAGCTGTTGTGCTTGTGGCCTGTGGTCAAG
GAACTGCTTCTAAAGACAACAAAGAGGCAGAACTTAAGAAGGTTGACTTTATCCTAGACTGGACACCAAATACCA
ACCACACAGGGCTTTATGTTGCCAAGGAAAAAGGTTATTTCAAAGAAGCTGGAGTGGATGTTGATTTGAAATTGC
CACCAGAAGAAAGTTCTTCTGACTTGGTTATCAACGGAAAGGCACCATTTGCAGTGTATTTCCAAGACTACATGGC
TAAGAAATTGGAAAAGGGAGCAGGAATCACTGCCGTTGCAGCTATTGTTGAACACAATACATCAGGAATCATCTC
TCGTAAATCTGATAATGTAAGCAGTCCAAAAGACTTGGTTGGTAAGAAATATGGGACATGGAATGACCCAACTGA
ACTTGCTATGTTGAAAACCTTGGTAGAATCTCAAGGTGGAGACTTTGAGAAGGTTGAAAAAGTACCAAATAACGA
CTCAAACTCAATCACACCGATTGCCAATGGCGTCTTTGATACTGCTTGGATTTACTACGGTTGGGATGGTATCCTT
GCTAAATCTCAAGGTGAGATGCTAACTTCATGTACTTGAAAAGACTATGTCAAGGAGTTTGACTACTATTCACCAG
TTATCATCGCAAACAACGACTATCTGAAAGATAACAAAGAAGAAGCTCGCAAAGTCATCCAAGCCATCAAAAAG
GCTACCAATATGCCATGGAACATCCAGAAGAAGCTGCAGATATTCTCATCAAGAATGCACCTGAACTCAAGGAAA
AACGTGACTTTGTCATCGAATCTCAAAAATACTTGTCAAAAGAATACGCAAGCGACAAGGAAAAATGGGGTCAAT
TGACGCAGCTCGCTGGAATGCTTTCTACAAATGGGATAAAGAAAATGGTATCCTTAAGAAGACTTGACAGACA
AAGGCTTCACCAACGAATTTGTGAAATAA

TABLE 1-continued 4106.4 (SEQ. ID. NO. 213)
ATGATAAAAAATCCTAAATTATTAACCAAGTCTTTTTTAAGAAGTTTTGCAATTCTAGGTGGTGTTGGTCTAGTCA
TTCATATAGCTATTTATTTGACCTTTCCTTTTTATTATATTCAACTGGAGGGGAAAAGTTTAATGAGAGCGCAAG
AGTGTTTACGGAGTATTTAAAGACTAAGACATCTGATGAAATTCCAAGCTTACTCCAGTCTTATTCAAAGTCCTTG
ACCATATCTGCTCACCTTAAAAGAGATATTGTAGATAAGCGGCTCCCTCTTGTGCATGACTTGGATATTAAAGATG
GAAAGCTATCAAATTATATCGTGATGTTAGATATGTCTGTTAGTACAGCAGATGGTAAACAGGTAACCGTGCAATT
TGTTCACGGGGTGGATGTCTACAAAGAAGCAAAGAATATTTTGCTTTTGTATCTCCCATATACATTTTTGGTTACA
ATTGCTTTTTCCTTTGTTTTTTCTTATTTTTATACTAAACGCTTGCTCAATCCTCTTTTTTACATTTCAGAAGTGACT
AGTAAAATGCAAGATTTGGATGACAATATTCGTTTTCATCAAACTAGGAAAGATGAAGTTGGTGAAGTTGGAAAA
CAGATTAATGGTATGTATGAGCACTTGTTGAAGGTTATTTATGAGTTGGAAAGTCTGTAATGAGCAAATTGTAAAAT
TGCAAAATCAAAAGGTTTCCTTTGTCCGCGGAGCATCACATGAGTTGAAAACCCCTTTAGCCAGTCTTAGAATTAT
CCTAGAGAATATGCAGCATAATATTGGAGATTACAAAGATCATCCAAAATATATTGCAAAGAGTATAAATAAGAT
TGACCAGATGAGCCACTTATTAGAAGAAGTACTGGAGTCTTCTAAATTCCAAGAGTGGACAGAGTGTCGTGAGAC
CTTGACTGTTAAGCCAGTTTTAGTAGATATTTTATCACGTTATCAAGAATTAGCTCATTCAATAGGTGTTACAATTG
AAAATCAATTGACAGATGCTACCAGGGTCGTCATGAGTCTTAGGGCATTGGATAAGGTTTTGACAAACCTGATTA
GTAATGCAATTAAATATTCAGATAAAAATGGGCGTGTAATCATATCCGAGCAAGATGGCTATCTCTCTATCAAAA
ATACATGTGCGCCTCTAAGTGACCAAGAACTAGAACATTTATTTGATATATTCTATCATTCTCAAATCGTGACAGA
TAAGGATGAAAGTTCCGGTTTGGGTCTTTACATTGTGAATAATATTTTAGAAAGCTATCAAATGGATTATAGTTTT
CTCCCTTATGAACACGGTATGGAATTTAAGATTAGCTTGTAG 4106.6 (SEQ. ID. NO. 214)
ATGTATTTAGGAGATTTGATGGAGAAAGCCGAGTGTGGTCAATTTTCAATACTTTCCTTTCTATTACAAGAGTCTC
AGACGACCGTCAAGGCTGTAATGGAAGAAACAGGATTTTCAAAAGCAACCCTAACCAAATATGTCACCCTGCTCA
ATGACAAGGCTTTGGATAGTGGCTTAGAGCTGGCTATTCACTCAGAAGATGAAAATCTGCGTCTGTCTATCGGTGC
AGCTACCAAGGGGAGAGATATTCGGAGCTTGTTTTTGGAGAGTGCTGTTAAATACCAGATTTTGGTTTATCTTCTC
TACCACCAACAGTTTTTAGCCCATCAGCTGGCTCAAGAATTGGTGATTAGCGAGGCTACGCTTGGTCGTCACTTGG
CTGGTTTAAATCAGATTTTGTCAGAATTTGATTTATCCATCCAAAATGGCCGTTGGCGAGGTCCAGAGCATCAGAT
TCACTATTTCTATTTCTGTCTTTTCCGAAAGGTCTGGTCGAGTCAGGAATGGGAAGGTCACATGCAGAAACCAGAG
AGAAAACAGGAGATTGCCAATTTAGAGGAAATCTGCGGTGCAAGTTTGTCTGCGGGGCAGAAATTGGACTTGGTT
CTCTGGGCTCACATCAGTCAACAACGTCTTCGGGTCAATGCTTGTCAGTTTCAAGTCATAGAAGAGAAAATGCGA
GGGTATTTTGACAATATCCTTTTATCTTCGTTTGCTGAGAAAGGTTCCGTCCTTTTTTGCTGGGCAACATATTCCACT
AGGAGTTGAGGATGGTGAGATGATGATATTCTTCTCTTTTCTCCTATCTCATCGCATTCTTCCTCTTCATACTATGG
AGTATATTCTTGGTTTTGGAGGGCAGTTGGCAGATTTACTGACGCAATTGATTCAAGAAATGAAGAAGGAGGAAC
TATTGGGGATTATACAGAGGACCATGTCACCTATGAACTCAGTCAGCTTTGTGCTCAAGTCTATCTCTATAAGGG
CTATATTTTACAGGATCGCTACAAGTACCAGTTAGAGAATCGTCATCCATATTTACTGATGGAACATGATTTTAAA
GAGACAGCAGAGGAGATTTTTCATGCTCTACCTGCTTTTCAACAGGGACAGGATTTAGATAAGAAGATTCTCTGGG
AATGGCTCCAGTTAATCGAATATATGGCTGAAAACGGTGGCCAGCATATGCGGATTGGTCTGGATTTGACATCTGG
TTTTTCTTGTCTTTTCAAGGATGGCAGCCATTTTGAAACGGTATTTGGAATACAATCGTTTTATTACCATTGAAGCTT
ATGACCCTAGTCGGCATTATGATTTGCTGGTTACCAATAACCCGATTCATAAGAAGGAACAGACACCAGTCTATTA
TTTAAAAAATGACTTGGATATGGAGGATTTGGTAGCGATTCGCCAGTTATTATTCACTTAA 4106.7 (SEQ. ID. NO. 215)
ATGGAATTTTCAAAAGAAAACACGTGAATTGTCAATTAAAAAAATGCAGGAACGTACCCTGGACCTCTTGATTATC
GGTGGAGGAATCACAGGAGCTGGTGTAGCCTTGCAGGCGGCAGCTAGCGGTCTTGAGCTGGTTTGATTGAAATG
CAAGACTTTGCAGAAGGAACATCTAGTCGTTCAACAAAATTGGTTCACGGAGGACTTCGTTACCTCAAACAATTTG
ACGTAGAAGTGGTCTCAGATACGGTTTCTGAACGTGCAGTGGTTCAACAAATCGCTCCACACATTCCAAAATCAG
ATCCAATGCTCTTACCAGTTTACGATGAAGATGGAGCAACCTTTAGCCTCTTCCGTCTTAAAGTAGCCATGGACTT
GTACGACCTCTTGGCCAGGTGTTAGCAACACACCAGCTGCGAACAAGGTTTTGGACAAGGATCAAGTCTTGGAACG
CCAGCCAAACTTGAAGAAGGAAGGCTTGGTAGGAGGTGGAGTGTATCTTGACTTCCGTAACAACGATGCGCGTCT
CGTGATTGAAAACATCAAACGTGCCAACCAAGACGGTGCCCTCATTGCCAACCACGTGAAGGCAGAAGGCTTCCT
CTTTTGACGAAAGTGGCAAGATTACAGGTGTTGTAGCTCGTGATCTCTTGACAGACCAAGTGTTTGAAATCAAGGCC
CGTCTGGTTATTAATACAACAGGTCCTTGGAGTGATAAAGTACGTAATTTGTCTAATAAGGGAACGCAATTCTCAC
AAATGCGCCCAACTAAGGGAGTTCACTTGGTAGTAGATTCAAGCAAAATCAAGGTTTCACAGCCAGTTTACTTCG
ACACAGGTTTGGGTGACGGTCGTATGGTCTTTGTTCTCCCACGTGAAAACAAGACTTACTTTGGTACAACTGATAC
AGACTACACAGGTGATTTGGAGCATCCAAAAGTAACTCAAGAAGATGTAGATTATCTACTTGGCATTGTCAACAA
CCGCTTCCCAGAATCCAACATCACCATTGATGATATCGAAAGCAGCTGGGCAGGTCTTCG
TCCATTGATTGCAGGGAACAGTGCCTCTGACTATAATGGTGGAAATTACGGTACCATCAGTGATGAAAGCTTTGA
CAACTTGATTGCGACTGTTGAATCTTATCTCTCCAAAGAAAAAACACGTGAAGATGTTGAGTCTGCTGTCAGCAAG
CTTGAAAGTAGCACATCTGAGAAACATTTGGATCCATCTGCAGTTTCTCGTGGGTCTAGCTTGGACCGTGATGACA
ATGGTCTCTTGACTCTTGCTGGTGGTAAAATCACAGACTACCGTAAGATGGCTGAAGGAGCTATGGAGCGCGTGG
TTGACATCCTCAAAGCAGAATTTGACCGTAGCTTTAAATTGACTAATTCTAAAACTTACCCTGTTTCAGGTGGAGA
ATTGAACCCAGCAAATGTGGATTCAGAAATCGAAGCCTTTGCGCAACTTGGAGTATCACGTGGTTTGGATAGCAA
GGAAGCTCACTATCTGGCAAATCTTTACGGTTCAAATGCACCGAAAGTCTTTGCACTTGCTCACAGCTTGGAACAA
GCGCCAGGACTCAGCTTGGCAGATACTTTGTCCCTTCACTATGCAATGCGCAATGAGTTGACTCTTAGCCCAGTTG
ACTTCCTTCTTCGTCGTACCAATCACATGCTCTTTATGCGTGATAGCTTGGATAGTATCGTTGAGCCAATTTTGGAT
GAAATGGGACGATTCTATGACTGGACAGAAGAAGAAAAAGCAACTTACCGTGCTGATGTCGAAGCAGCTCTCGCT
AACAACGATTTAGCAGAATTAAAAAATTAA 4106.8 (SEQ. ID. NO. 216)
ATGATGAATGAATTATTTGGAGAATTTCTAGGGACTTTAATCCTGATTCTTCTAGGAAATGGTGTTGTTGCAGGTG
TGGTTCTTCCTAAAACCAAGAGCAATAGCTCAGGTTGGATTGTGATTACTATGGGTTGGGGGATTGCAGTTGCGGT
TGCAGTCTTTGTATCTGGCAAGCTCAGTCCAGCTTATTTAAACCCAGCTGTGACCATCGGTGTGGCCTTAAAAGGT
GGTTTGCCTTGGGCTTCCGTTTTGCCTTATATCTTAGCCCAGTTCGCAGGGGCCATGCTGGGTCAGATTTTGGTTTG
GTTGCAATTCAAACCTCACTATGAGGCAGAAGAAAATGCAGGCAATATCCTGGCAACCTTCAGTACTGGACCAGC
CATCAAGGATACTGTATCAAACTTGATTAGCGAAATCCTTGGAACTTTTGTTTTGGTGTTGACAATCTTTGCTTTGG
GTCTTTACGACTTTCAGGCAGGTATCGGAACCTTTGCAGTGGGAACTTTGATTGTCGGTATCGGTCTATCACTAGG
TGGGACAACAGGTTATGCCTTGAACCCAGCTCGTGACCTTGGACCTCGTATCATGCACAGCATCTTGCCAATTCCA

TABLE 1-continued

AACAAGGGAGACGGAGACTGGTCTTACGCTTGGATTCCTGTTGTAGGCCCTGTTATCGGAGCAGCCTTGGCAGTG
CTTGTATTCTCACTTTTCTAG 4106.10 (SEQ. ID. NO. 217)
ATGAAAAGGACCTGGAGGAACTCATTCGTGACAAATCTTAATACACCTTTTATGATTGGCAATATTGAGATTCCCA
ATCGTACCGTTTTAGCGCCTATGGCTGGCGTGACCAACTCAGCCTTTCGTACTATCGCAAAGGAGCTCGGAGCTGG
ACTCGTTGTAATGGAAATGGTCTCTGACAAGGGAATCCAATACAACAACGAAAAAACCCTGCACATGCTTCATAT
CGATGAGGGCGAAAACCCTGTCTCTATCCAACTTTTTGGTAGCGATGAAGACAGCCTAGCACGCGCAGCAGAATT
CATCCAAGAAAACACCAAGACCGATATCGTCGATATCAACATGGGCTGCCCTGTCAACAAAATCGTGAAGAACGA
AGCTGGTGCTATGTGGCTCAAGGATCCAGACAAGATTTACTCCATCATCAACAAGGTCCAGTCTGTCCTTGATATC
CCACTTACTGTCAAAATGCGTACCGGCTGGGCGGACCCATCTCTTGCAGTAGAAAATGCTCTCGCTGCTGAAGCTG
CAGGTGTTTCTGCCCTCGCCATGCATGGCCGTACCCGTGAACAAATGTATACTGGCCACGCAGACCTTGAGACCCT
TTACAAGGTTGCCCAAGCTCTAACCAAGATTCCATTCATCGCCAACGGTGATATCCGTACTGTCCAAGAAGCCAA
GCAACGCATCGAAGAAGTTGGTGCTGACGCAGTCATGATTGGCCGAGCTGCCATGGGAAATCCTTACCTCTTCAA
CCAAATCAACCATTACTTTGAAACAGGAGAAATCCTACCTGATTTGACCTTTGAAGACAAGATGAAGATCGCCTA
GGAACACTTGAAACGATTGATTAACCTCAAAGGAGAAAACGTCGCAGTTCGTGAATTCCGCGGTCTCGCTCCTCA
CTATCTCCGTGGAACATCTGGCGCTGCCAAACTCCGTGGAGCCATTTCGCAAGCCAGCACCCTGGCAGAGATTGA
AACCCTCTTGCAATTGGAGAAGGCTTAA 4107.1 (SEQ. ID. NO. 218)
ATGACAAAGAAGAAAATTGAGCGTATTTCTGTAATACACCGAGAAAAGATTTTATGGCTCAAGTGGTATTTCATGC
GAGATAAAGAACAACCTAAGTATAGTGTCCTTGAGCGTAAAATGTTTGATGCTGCTAAAAATCAAGATATGCTAG
CTTATCAAAAATACGCAACTATCAAGCAGATAACAGATATTAGGGTACAAACAAGTGAGGCTGACATTTTAGAGG
CTGTAAAAGAGGTTTATGTGTACAATCACATGAATGTTATCGGAGCTTGTCAGCGGATATTATTTATCAGTCAATC
ACCAGCTTATGATAAGTTAAATAAGTGGTTTAATATCTATTCTGATTTGTATTTTAGCGTTGTACCCTTGCCCAAAA
TGGGGGTATATCATGAGATGGTAGGTATCTAG 4107.2 (SEQ. ID. NO. 219)
ATGAAAAAATTCCAACGAGGCTGAGATGAAATTACTTTATACTGATATTCGGACTTCTTTGACAGAAATTCTAACAA
GAGAGGCAGAAGAGCTAGTTGCAGCTGGCAAGCGGGTCTTCTACATTGCCCCCAACTCTCTTTCTTTTGAAAAGGA
ACGCGCCGTGCTGGAATACTTGTCCCAGCAGGCTTCTTTTTCGATTACCGTCACGCGCTTTGCTCAAATGGCTCGC
TATCTGGTCTTGAATGATTTACCAGCTAAAACTACTCTTGATGATATCGGTCTTGGGTTGGCCTTTTACAAATGCCT
TGCCGAACTCGATCCCAAGGACTTGCGTGTTTATGGCGCTATTAAGCAGGATCCTCAATTGATCCAGCAGTTAATT
GAGCTTTACCATGAGATGACCAAATCTCAGATGAGTTTTTTGGACTTGGAGAATTTAACAGATGAGGATAAGAGG
GCGGATTTACTCTTGATTTTTGAGAAAGTAACAGCCTATCTTAATCAAGGTCAGTTAGCCCAGGAAAGTCAGTTGT
CCCATTTGATTGAGGCTATTGAGAATGACAAGGTAAGTAGTGATTTTAATCAAATCGCCTTGGTCATTGACGGCTT
TACTCGTTTTTCTGCTGAGGAAGAGCGGGTTGTGGACTTACGGCAAAGGTGTTGAGATTGTTATCGGGGCT
TATGCTAGTAAGAAAGCCTATACCAGTCCTTTTAGCGAGGGCAATCTCTACCAAGCCAGCGTAAAATTTCTCCATC
ATCTGGCTTCTAAATACCAAACGCCTGCTCAGGACTGTTCTCAAACTCATGAGAAGATGGATAGTTTTGACAAGGC
CTCTCGTTTGTTGGAGTCTTCTTATGACTTTTCAGAACTCGCTTTGGATGTCGATGAGAAAGACCGTGAAAATTTA
CAAATCTGGTCTTGTTTGACGCAAAAGGAGGAGTTGGAGCTAGTAGATCCGTAGTATTCGTCAGAAATTACATGAG
AACTCAGACCTGAGCTACAAGCATTTTCGTATTCTCTTGGGGGATGTAGCTTCTTACCAGTTATCTCTCAAAACCA
TTTTTGACCAGTATCAGATTCCTTTTTATCTTGGTAGAAGCGAAGCCATGGCTCATCATCCCTTGACTCAGTTTGTC
GAGTCTATTTTAGCTTTAAAACGTTACCGTTTTCGTCAGGAGGATTTGATTAATCTTCTTAGAACTGATTTGTATAC
TGACCTCAGTCAGTCTGATATTGATGCTTTTGAGCAATATATCCGTCTATCTTGGTATCAATGGCTTGCCAGCCTTC
AGCAAACCTTCACCAAATCCCACCATGGAAAATTTAATCTTGAGCGTTTGAATGTCCTCCGCCTGAGAATTTTAGC
ACCTCTTGAAACCCTCTTTGCCAGCCGAAAACAAAAGGCTGAAAAACTCCTACAAAAATGGAGTGTCTTTCTAAA
AGAAGGAGCTGTGACCAAGCAGTTACAAGATTTGACAACCACTTTGGAAGCTGTAGAACAGGAAAGACAAGCCG
AAGTTTGGAAGGCTTTCTGCCATGTTTTAGAACAATTTGCGACTGTTTTTGCTGGTTCACAGGTTAGTCTGGAAGA
CTTCCTAGCCTGCTCCATTCTGGAATGAGTTTGTCCCAATACCGTACCATTCCAGCAACAGTGGACACTGTTCTG
GTGCAGCGTTACGATTTGATTGCACCATTGACTGCTGACTTTGTCTATGCTATTGGACTAACTCAGGACCATTTAC
CAAAAATTTCTCAAAACACCAGTCTTCTGACAGATGAAGAAAGGCAAAACCTAAACCAAGCGACCGAAGAAGGC
GTTCAATTACTGATTGCCAGCAGTGAAAATCTCAAGAAAAATCGCTACACTATGCTTTCCTTGGTCAATTCTGCTC
GTAAGCAGTTGTTCTTGTCGGCTCCAAGCCTTTTTAACGAAAGTGAAAGTAAAGGAATCTGCCTATCTTCAAGAGTT
GATCCATTTTGGATTTAGGCGGAGAGAAGAGGATGAATCACAAAGGACTGTCTAAGGAGGATATGGGGTCCTA
TCACAGTCTTTTGTCTAGTCTGGTTGCCTATCACCAGCAGGGTGAGATGAGCGATACTGAGCAAGATTTGACTTTT
GTCAAGGTTCTGTCGCGTGTCATAGGTAAAAAACTAGATCAGCAAGGTCTGGAAAATCCAGCTATCCCAACCAGT
CCAAGCAGCAAGACCTTAGCCAAGGACACCTTGCAAGCTCT
CTATCCTGCCAAACAGGAGTTTTACCTGTCTACGTCGGGTTTGACAGAGTTTTATCGCAATGAATACAGTTATTTC
CTACGCTACGTTTTAGGCTTGCAGGAGGAATTACGTTTGCATCCTGATGCCCGTAGTCACGGGAATTTCTTGCATC
GTATCTTTGAACGCGCCTTACAGTTGCCTAATGAAGATTCCTTTGACCAACGTCTAGAACAAGCTATTCAAGAAAC
CAGTCAAGAACGCGAATTTGAAGCTATTTATCAAGAAACTTTGGAAGCCCAGTTTACCAAGGAAGTTTTGCTTGAT
GTTGCACGGACAACTGGACATATTCTCCGACACAATCCAGCCATCGAAACCATCAAAGAAGAAGCAAATTTTGGT
GGAAAAGACCAAGCCTTTATTCAATTAGCACAATGGACGCAGTGTCTTTGTACGAGGCAAGGTGGACCGGATTGAC
CGTTTGAAAGCTAATGGAGCGATAGGAGTAGTAGACTACAAATCCAGTCTGACTCAGTTCCAGTTTCCTCATTTCT
TTAATGGGCTCAATTCTCAGTTACCAACCTATCTTGCTGCCCTAAAAAGAGAAGGGGAGCAGAACTTTTTCGGCGC
CATGTACTTGGAAATGGCTGAACCTGTCCAATCTCTGATGGCGGTAAAAAGTCTGGCAGGAGCAGTGGTAGAAGC
CAGCAAATCTATGAAATACCAAGGGCTCTTCTTGGAAAAAGAAAGCAGTTATTTAGGCGAATTTTATAACAAAAA
CAAGGCTAATCAACTGACAGATGAGGAATTTCAGCTCCTACTGGACTACAATGCCTATCTTTACAAGAAAGCTGCT
GAGAAGATTTTAGCAGGCCGGTTCGCCATCAATCCTTATACTGAAATGGCAGAAGCATTGCCCCATACGTCCAG
CAACATCAGGCTATTACAGGCTTTGAAGCCAATTACCATCTGGGCCAAGCCCGTTTCCTAGAAAAGTTGGACCTAG
CTGATGCAAGCGTCTGGTCGGAGAAAAACTCAAGCAAGCTTGGCTTGAAAAAATAA
GAGAGGAGTTGAATCGATGA 4107.3 (SEQ. ID. NO. 220)
ATGAAGCTTATTCCCTTTTTAAGTGAGGAGGAGATTCAAAAACTGCAAGAAGCAGAAGCAAATTCGAGCAAGGAA
CAGAAGAAAACTGCCGAGCAAATCGAAGCTATCTACACTTCTGCCCAGAATATCCTGGTCTCAGCATCGGCTGGT
TCTGGAAAGACCTTTGTCATGGCAGAGCGCATTCTGGACCAATTGGCGCGTGGTGTCGAAATTTCTCAACTCTTTA
TCTCAACCTTTACCGTCAAGGCTGCAACTGAACTTAAAGAACGTTTAGAGAAAAAAATCAGCAAGAAAATCCAAG

TABLE 1-continued

```
AAACAGATGATGTCGACCTCAAACAACACTTGGGTCGCCAGTTGGCAGACCTACCCAACGCTGCCATTGGAACCA
TGGATTCTTTCACACAAAAATTCCTTGGCAAACATGGTTATCTGCTTGATATTGCACCTAATTTCCGTATTTTACAA
AACCAAAGCGAGCAACTTATTCTCGAAAACGAAGTCTTTCATGAGGTCTTTGAAGCGCATTACCAAGGTAAACAG
AAAGAGACCTTTAGTCATTTGCTGAAAAACTTTGCTGGGCGTGGCAAGGACGAACGGGGTCTGCGCCAGCAGGTC
TATAAAATCTATGACTTCCTCCAATCCACCAGTAATCCTCAAAAGTGGCTGAGTGAATCTTTCCTCAAAGGATTTG
AGAAAGCTGATTTTACCAGTGAAAAGAAAAACTGACCGAGCAAATCAAACAAGCCCTTTGGGATTTGGAAAGCT
TTTTCCGTTACCATCTGGATAACGATGCCAAGGAGTTTGCAAAGGCTGCCTATTTAGAAAATGTTCAGTTAATTCT
GGATGAAATTGGCTCCCTAAATCAGGAGTCCGATAGTCAGGCTTATCAGGCAGTGCTTGCGCGTGTTGTCGCCATC
TCTAAGGAGAAAAACGGTCGAGCTCTGACTAATGCCAGCCGTAAGGCTGATTTGAAGCCCCTGGCTGATGCCTAC
AACGAAGAGAGAAAGACCCAGTTTGCTAAACTAGGACAATTATCAGACCAGATAGCGAT
TCTCGACTATCAAGAACGTTATCATGGAGACACTTGGAAACTAGCTAAAACCTTCCAATCTTTCATGAGCGATTTT
GTAGAGGCTTATCGTCAGAGAAAACGACAGGAAAATGCCTTCGAATTCGCTGATATCAGCCATTACACCATTGAG
ATTTTAGAGAATTTCCCACAAGTTCGTGAGTCTTATCAGGAGCGCTTCCATGAAGTCATGGTCGATGAGTATCAGG
ATACCAACCATATTCAAGAACGGATGCTGGAATTGTTGTCTAATGGCCACAATCGCTTTATGGTGGGAGATATCAA
GCAATCCATCTATCGTTTCCGTCAGGCAGACCCGCAGATTTTCAATGAGAAATTCCAACGCTATGCGCAAAATCCC
CAAGAAGGCAGGCTCATTATCCTCAAGGAAAATTTCCGTAGTAGTTCAAAGTGCTGTCAGCAACCAATGATGTC
TTTGAACGTCTCATGGACCAAGAGGTCGGCGAAATCAACTATGATAACAAGCACCAGCTTGTTTTGCCAATACCA
AACTGACTCCCAATCCAGACAACAAGGCAGCATTTCTCCTCTACGACAAGGACGATACAGGTGAGGAAGAAGAGA
GTCAAACAGAAACGAAACTAACAGGCGAAATGCGCTTAGTTATCAAGGAGATTCTGAAACTTCATCAAGAAAAG
GTGTTGCCTTTAAGGAAATTGCCCTTCTGACCTCCAGCCGCAGCTGTAATGACCAGATTCTCCTCGCCCTGTCTGA
GTACGGAATTCCTGTCAAAACTGACGGAGAGCAAAACAATTATCTCCAATCCCTAGAAGTGCAAGTCATGCTAGA
CACTCTTCGTGTCATTCACAATCCCCTGCAAGACTACGCCTTGGTTGCCCTTATGAAGTCTCCAATGTTTGTTTTG
ATGAGGATGAGCTAGCACGTTTGTCCCTTCAGAAAGCAGAGGATAAAGTCCACGAAAATCTCTATGAGAAACTGG
TCAATGCACAAAAAATGGCAAGTAGTCAAAAAGGCTTGATTCACACAGCTCTAGCTG
AAAAACTAAAGCAATTCATGGATATCCTAGCTTCTTGGCGCTTGTATGCCAAAACCCACTCTCTCTATGACTTGAT
TTGGAAGATTTACAACGACCGTTTTTATTATGACTATGTTGGGGCTTTGCCGAATGGTCCTGCTAGGCAGGCCAAT
CTCTATGCCCTAGCACTGCGTGCTGATCAATTTGAAAAGAGCAATTTCAAAGGTTTGTCGCGTTTTATTCGTATGA
TTGACCAAGTCTTAGAAGCCCAGCACGATTTGGCAAGCGTGGCCGTCGCACCGCCAAAAGATGCAGTAGAGCTCA
TGACCATCCACAAGAGTAAAGGGCTGGAGTTTCCTTACGTCTTTTATCCTCAATATGGATCAAGATTTCAACAAGCA
AGACTCTATGTCAGAAGTCATTCTCAGTCGTCAGAATGGTCTTGGTGTCAAATATATTGCCAAGATGGAGACAGGG
GCAGTAGAAGACCACTATCCTAAAACCATCAAACTCTCCATTCCTAGTCTGACCTATAGGCAGAACGAAGAGGAA
TTACAGCTAGCAAGCTATTCTGAGCAGATGCGTTTGCTGTATGTTGCTATGACGCGGCTGAGAAAAAGCTCTATC
TTGTCGGCAAGGGTTCTCGTGAAAAGCTGGAATCCAAGGAATACCCAGCAGCCAAAAATGGGAAACTAAATAGCA
ATACTAGACTGCAAGCACGGAATTTCCAAGATTGGCTTTGGGCTATCAGTAAAGTGTTTACTAAGGACAAGCTCA
ACTTTAGTTATCGTTTTATTGGCGAAGATCAGTTGACCAGAGAAGCTATCGGAGAGTTGGAAACCAAGAGTCCTCT
CCAAGATAGCTCCCAAGCAGACAATCGTCAGTCAGATACCATCAAAGAAGCTCTGGAAATGCTGAAGGAGGTGGA
AGTTTATAATACTCTTCACCGCGCAGCTATTGAACTTCCTAGTGTTCAACCCCAAGTCAAATCAAGAAATTCTAC
GAACCAGTTATGGATATGGAAGGTGTCGAGATTGCTGGTCAAGGTCAGTCAGTAGGCAAGAAAATCAGCTTCGAT
TTGCCAGATTTTTCAACCAAAGAAAAGGTAACTGGAGCTGAGATTGGTAGTGCTACTCACGAACTCATGCAGAGA
ATTGACCTCAGCCAGCAACTAACCCTTGCTAGCCTAACAGAAACACTCAAACAAGTTCAAACTAGCCAAGCTGTC
AGAGACAAGATCAATCTTGATAAAATTCTTGCTTTCTTTGACACAGTACTCGGTCAGGAAATTCTTGCTAATACCG
ACCATCTTTATCGCGAGCAACCTTTCTCCATGCTCAAACGAGACCAAAAGAGTCAGGAAGACTTTGTTGTCCGTGG
TATCCTTGATGGCTATCTGCTTTACGAAAACAAAATTGTTCTGTTCGACTACAAGACAGACCGCTATGATGAACCA
AGTCAACTCGTAGACCGCTATCGTGGTCAGTTAGCTCTATACGAAGAGGCTTTATCACGAGCCTATTCGATTGAAA
ATATTGAAAAATACTTGATTTTACTCGGTAAAGACGAGGTTCAAGTTGTAAAAGTATAA
```

4109.1 (SEQ. ID. NO. 221)
```
ATGGAACTTGCTCGCCATGCTGAAACGTTGGGAGTAGATGCTATTGCAACGATTCCACCAATTTATTTCCGCTTGC
CAGAATACTCAGTTGCCAAATACTGGAACGATATCAGTTCTGCAGCTCCAAACACAGACTACGTGATTTACAACA
TTCCTCAATTGGCAGGGGTTGCTTTGACTCCAAGCCTTTACACAGAAATGTTGAAAAATCCTCGTGTTATCGGTGT
GAAGAACTCTTCTATGCCAGTTCAAGATATCCAAACCTTTGTCAGCCTTGGTGGAGAAGACCATATCGTCTTTAAT
GGTCCTGATGAGCAGTTCCTAGGAGGACGCCTCATGGGGGCTAGGGCTGGTATCGGTGGTACTTATGGTGCTATGC
CAGAACTCTTCTTGAAACTCAATCAGTTGATTGCGGATAAGGACCTAGAAACAGCGCGTGAATTGCAGTATGCTAT
CAACGCAATCATTGGTAAACTCACTTCTGCTCATGGAAATATGTACGGTGTCATCAAAGAAGTCTTGAAAATCAAT
GAAGGCTTGAATATTGGATCTGTTCGTTCACCATTGACACCAGTGACTGAAGAAGATCGTCCAGTTGTAGAAGCG
GCTGCTGCCTTGATTCGTGAAACCAAGGAGCGCTTCCTCTAA
```

4110.2 (SEQ. ID. NO. 222)
```
ATGTATAAGACAAAGTGTTTACGAGAGAAGTTAGTATTATTTTTAAAAATTTTCTTCCCAATCCTGATCTACCAAT
TTGCCAATTATTCTGCCTCTTTTGTTGATACTGCAATGACAGGTCAATACAACACTATGACTTGGCTGGTGTATCT
ATGGCAACCAGTATCTGGAATCCTTTCTTTACATTTCTAACAGGGATTGTGTCAGCCTTGGTGCCTATCATTGGTCA
CCATCTTGGTCGAGGCAAAAAGGAAGAAGTTGCGTCTGATTTTTACCAATTTATTTATTTGGCCTTGGGCCTATCT
GTGGTCTTGCTGGGGATGGTACTTTTCTTGGCACCAATAATCTTGAATCATATTGGGTTAGAAGCAGCAGTAGCGG
CAGTAGCGGTTCGCTATCTTTGGTTTTTATCTATCGGGATTATCCCCTTGTTGCTCTTTAGCGTCATTCGTTCCTTGC
TGGATTCGCTGGGCTTGACCAAACTGTCCATGTACCTCATGCTTTTCTTACTCCCTCTCAATAGCGGATTTAACTAT
CTCTTGATTTACGGTGCCTTTGGTGTTCCACAACTGGGAGGGGCTGGTTAGGAACATCCTTGGCCTACT
GGGTCTTGCTTGGGATTTCTGTTCTGGTTTTATTTAAACAGGAGAAGCTCAAAGCCTTACACCTTGAGAAACGAAT
TCCACTTAATATGGATAAAATTAAGGAAGGAGTTCGTTTAGGTCTGCCTATTGGGGAACTGTCTTCGCGGAAGTG
GCTATCTTTTCAGTGGTTGGCTTGATTATGGCTAAGTTTTCGCCCTTGATTATAGCTAGTCACCAGTCAGCTATGAA
CTTTTCAAGTCTTATTGTACGCCTTTCCTATGAGTATCTCATCGGCTATGGCTATTGTCGTTTCCTATGAAGTGGGAG
CCAAGCGATTTGATGATGCGAAAACCTATATTGGTCTAGGAAGATGGACTGCCCTCATTTTTCGGCCTTCACCTT
AACCTTCCTTTACATTTTTAGGGGAAATGTGGCCAGTCTTTATGTAACGACCCAAAATTTATCGATTTGACAGTG
CGTTTTTAACTTATAGTCTTTTCTTCCAGTTAGCAGATACCTTTGCGGCGCCGCTTCAGGGAATTTTGCGGGGGTA
TAAGGATACAGTTATTCCTTTTTACCTTGGTTTGCTTGGTTATTGGGGCTAGCAATCCCTGTGTACGCTATTTGA
```

4112.2 (SEQ. ID. NO. 223)
```
ATGAGTACTTTAGCAAAAATAGAAGCGCTCTTGTTTGTAGCGGGTGAAGATGGGATTCGGGTCCGCCAGTTAGCT
GAACTCCTCTCTCTGCCACCGACAGGCATCCAGCAAAGTTTAGGAAAATTAGCCCAGAAGTATGAAAAGGACCCA
GATTCCAGTTTGGCTTTGATTGAGACAAGTGGTGCTTATAGATTGGTGACCAAGCCTCAAATTTGCAGAGATTTGA
```

TABLE 1-continued

AGGAATACTCTAAGGCGCCTATCAACCAGAGCTTGTCTCGGGCTGCCCTTGAGACCTTGTCCATTATTGCCTACAA
ACAGCCGATTACGCGGATAGAAATTGATGCCATCCGTGGAGTTAACTCGAGTGGAGCCTTGGCAAAGTTGCAGGC
TTTTGACCTGATAAAGGAAGACGGGAAAAAGGAAGTATTGGGCGCCCCAACCTCTATGTGACTACGGATTATTT
CCTAGATTACATGGGGATAAACCATTTAGAAGAATTACCAGTGATTGATGAGCTTGAGATTCAAGCCCAAGAAAG
CCAATTATTTGGTGAAAGGATAGAAGAAGATGAGAATCAATAA 4113.1 (SEQ. ID. NO. 224)
ATGGATACGATGATTAGTAGATTTTTTCGCCATTTATTTGAAGCCTTAAAAAGTTTGAAACGAAATGGTTGGATGA
CAGTAGCTGCTGTCAGTTCAGTCATGATTACTTTGACCTTGGTGGCAATATTTGCATCTGTTATTTTCAATACAGCG
AAACTAGCTACAGATATTGAAAATAATGTCCGTGTAGTAGTTTATATCCGAAAGGATGTGGAAGATAATAGTCAG
ACAATTGAAAAGAAGGTCAAACTGTTACAAATAATGACTACCACAAGGTATATGATTCTTTGAAGAACATGTCT
ACGGTTAAAAGTGTTACCTTTTCAAGTAAAGAAGAACAATATGAAAAATTAACCGAGATAATGGGAGATAACTGG
AAAATCTTTGAAGGAGATGCCAATCCTCTCTATGATGCCTATATTGTAGAGGCAAACACTCCAAATGATGTAAAA
ACTATAGCCGAAGATGCTAAAAAAATTGAAGGTGTCTCTGAGGTTCAAGATGGCGGTGCCAATACAGAAAGACTC
TTCAAGTTAGCTTCATTTATCCGTGTTTGGGGACTAGGGATTGCTGCTTTGTTAATTTTTATCGCAGTTTTCTTGAT
TTCAAATACCATTCGTATTACCATTATTTCCCGCAGTCGCGAAATTCAAATCATGCGCTTGGTCGGAGCTAAAAAC
AGTTATATCCGTGGACCGTTCTTGTTAGAAGGAGCCTTTATCGGTTTATTGGGAGCTATCGCACCATCTGTTTTGGT
CTTTATTGTTTATCAAATTGTTTACCAATCTGTCAACAAATCGTTGGTAGGGCAAAATCTATCCATGATTAGTCCA
GATTTATTTAGTCCGTTGATGATTGCCCTACTATTTGTGATTGGGGTTTTCATTGGTTCATTGGGATCAGGAATATC
CATGCGCCGATTCTTGAAGATTTAG 4117.1 (SEQ. ID. NO. 225)
ATGAAGAAAGTAAGATTTATTTTTTTAGCTCTGCTATTTTTCTTAGCTAGTCCAGAGGGTGCAATGGCTAGTGATG
GTACTTGGCAAGGAAAACAGTATCTGAAAGAAGATGGCAGTGCAGCAAATGAGTGGGTTTTTGATACTCATT
ATCAATCTTGGTTCTATATAAAAGCAGATGCTAACTATGCTGAAAATGAATGGCTAAAGCAAGGTGACGACTATTT
TTACCTCAAATCTGGTGGCTATATGGCCAAATCAGAATGGGTAGAAGACAAGGGAGCCTTTTATTATCTTGACCAA
GATGGAAAGATGAAAAGAAATGCTTGGGTAGGAACTTCCTATGTTGGTGCAACAGGTGCCAAAGTAATAGAAGAC
TGGGTCTATGATTCTCAATACGATGCTTGGTTTTATATCAAAGCAGATGGACAGCACGCAGAGAAAGAATGGCTC
CAAATTAAAGGGAAGGACTATTATTTCAAATCCGGTGGTTATCTACTGACAAGTCAGTGGATTAATCAAGCTTATG
TGAATGCTAGTGGTGCCAAAGTACAGCAAGGTTGGCTTTTTGACAAACAATACCAATCTTGGTTTTACATCAAAGA
AAATGGAAACTATGCTGATAAAGAATGGATTTTCGAGAATGGTCACTATTATTATCTAAAATCCGGTGGCTACATG
GCAGCCAATGAATGGATTTGGGATAAGGAATCTTGGTTTTATCTCAAATTTGATGGGAAAATGGCTGAAAAAGAA
TGGGTCTACGATTCTCATAGTCAAGCTTGGTACTACTTCAAATCCGGTGGTTACATGACAGCCAATGAATGGATTT
GGGATAAGGAATCTTGGTTTTATCTCAAATCTGATGGGAAAATAGCTGAAAAAGAATGGGTCTACGATTCTCATA
GTCAAGCTTGGTACTACTTCAAATCCGGTGGTTACATGACAGCCAATGAATGGATTTGGGATAAGGAATCTTGGTT
TTACCTCAAATCTGATGGGAAAATAGCTGAAAAAGAATGGGTCTACGATTCTCATAGTCAAGCTTGGTACTACTTC
AAATCTGGTGGCTACATGGCGAAAAATGAGACAGTAGATGGTTATCAGCTTGGAAGCGATGGTAAATGGCTTGGA
GGAAAAACTACAAATGAAAATGCTGCTTACTATCAAGTAGTGCCTGTTACAGCCAATGTTTATGATTCAGATGGTG
AAAAGCTTTCCTATATATCGCAAGGTAGTGTCGTATGGCTAGATAAGGATAGAAAAAGTGATGACAAGCGCTTGG
CTATTACTATTTCTGGTTTGTCAGGCTATATGAAAACAGAAGATTTACAAGCGCTAGATGCTAGTAAGGACTTTAT
CCCTTATTATGAGAGTGATGGCCACCGTTTTTATCACTATGTGGCTCAGAATGCTAGTATCCCAGTAGCTTCTCAT
CTTTCTGATATGGAAGTAGGCAAGAAATATTATTCGGCAGATGGCCTGCATTTTGATGGTTTTAAGCTTGAGAATC
CCTTCCTTTTCAAAGATTTAACAGAGGCTACAAACTACAGTGCTGAAGAATTGGATAAGGTATTTAGTTTGCTAAA
CATTAACAATAGCCTTTTGGAGAACAAGGGCGCTACTTTTAAGGAACATTACCATATCAATGTCTTT
TATCTCCTTGCCCATAGTGCCCTAGAAAGTAACTGGGGAAGAAGTAAAATTGCCAAAGATAAGAATAATTTCTTTG
GCATTACAGCCTATGATACGACCCCTTACCTTTCTGCTAAGACATTTGATGATGTGGATAAGGGAATTTTAGGTGC
AACCAAGTGGATTAAGGAAAATTATATCGATAGGGGAAGAACTTTCCTTGGAAACAAGGCTTCTGGTATGAATGT
GGAATATGCTTCAGACCCTTATTGGGCGAAAAAATTGCTAGTGTGATGATGAAAATCAATGAGAAGCTAGGTGG
CAAAGATTAG 4119.2 (SEQ. ID. NO. 226)
ATGAAAAAAGTATTACAAAAATATTGGGCATGGGCTTTTGTGGTCATCCCCCTCTTGTTACAAGCAATTTTCTTCT
ATGTGCCGATGTTTCAAGGAGCCTTTTACAGTTTTACCAACTGGACAGGATTGACTTATAACTACAAATTTGTTGG
CTTAAACAACTTTAAGCTCCTCTTCATGGATCCAAAATTCATGAATGCGATTGGCTTTACCGCAATCATTGCGATT
GCCATGGTGGTTGGTGAGATTGCACTCGGGATCTTCATTGCGCGTGTCTTGAATTCTAAAATCAAAGGCCAAACCT
TCTTCCGTGCTTGGTTCTTCTTCCCAGCTGTTTTATCTGGTTTGACAGTGGCTTTGATCTTCAAGCAAGTCTTCAAC
TACGGTCTTCCAGCGATTGGAAATGCCCTTCATATTGAATTTTTCCAAACCAGTCTTTTAGGGACTAAGTGGGGAG
CAATCTTTGCGGCTGTCTTTGTCCTTCTTTGGCAAGGGGTGGCTATGCCCATCATCATCTTCCTAGCTGGTTTGCAA
TCTATTCCAACTGAGATTACAGAGGCAGCAAGGATTGATGGTGCGACTAGCAAGCAAGTTTTCTGGAACATTGAA
TTGCCTTACTTGCTACCAAGTGTCTCTATGGTCTTTATCCTAGCCTAAAAGGTGGCTGACTGCCTTTGACCAAGT
CTTTTGCCATGACCGGTGGTGGTCCAAACAATGCCACAACCTCACTTGGGCTCTTGGTTTATAACTATGCCTTTAAA
AACAACCAATTCGGTTATGCCAATGCCATTGCCGTAATCTTGTTCTTCTTAATTGTAGTGATTTCGATCATCCAATT
GAGAGTATCTAAGAAATTTGAAATTTAA 4119.3 (SEQ. ID. NO. 227)
ATGATGAAACAAGATGAAAGAAAAGCCCTGATTGGCAAATACATTCTATTGATTCTAGGATCGGTTCTGATTTTAG
TGCCGCTCCTTGCTACCCTCTTTAGTTCCTTCAAACCCACTAAGGATATTGTAGATAATTTCTTTGGCTTTCCAACC
AACTTCACATGGGACAACTTTAGCCGTCTCTTAGCTGATGGGATTGGAGGCTATTATTGGAACTCTGTCGTCATCA
CTGTCTTGTCTTTACTTGCAGTAATGATCTTTATCCCTATGGCAGCGTACTCCATCGCTCGCAATATGAGTAAAAG
AAAAGCCTTTACCATCATGTATACCCTCTTAATCCTCGGAATCTTCGTACCTTTCCAAGTCATCATGATTCCGATTA
CGGTTATGATGAGTAAACTCGGTTTGGCTAATACCTTTGGTTTGATCTTGCTCTACTTGACCTATGCGATTCCACAG
ACCCTCTTTCTCTATGTTGGCTATATCAAAATCTCGATTCCAGAAAGTCTGGATGAAGCAGCAGAGATCGATGGGG
CTAATCAATTTACAACCTATTTCCGCATCATCTTCCCAATGATGAAACCGATGCATGCGACAACCATGATCATCAA
TGCCCTTTGGTTCTGGAATGACTTCATGTTGCCACTCCTTGTCTTGAACCGGGATTCCAAAATGTGGACTCTGCCTT
TGTTCCAATACAACTACGCAGGCCAATATTTCAACGACTACGGACCAAGCTTTGCCTCTTACGTGGTCGGCATTAT
CAGTATCACCATTGTCTATCTCTTCTTCCAACGCCATATCATTTCAGGAATGAGCAACGGGGCAGTGAAGTAA

TABLE 1-continued 4119.4 (SEQ. ID. NO. 228)
ATGAAAAGTATTCTTCAGAAAATGGGGGAGCATCCGATGCTGCTTCTTTTTCTTAGCTATAGTACTGTTATATCCA
TTCTTGCACAAAATTGGATGGGTCTTGTGGCTTCAGTAGGAATGTTTCTATTTACTATTTTCTTTTTGCACTATCAG
TCGATTTTATCCCATAAATTCTTTCGATTGATTTTGCAGTTTGTCTTGTTTGGTAGTGTCTTGTCAGCTGCTTTTGCC
AGTTTAGAACATTTCCAAATTGTGAAGAAATTTAACTATGCTTTTCTTTCACCCAATATGCAGGTGTGGCATCAGA
ACCGGGCAGAAGTGACCTTCTTTAATCCTAATTATTATGGAATTATTTGTTGTTTCTGTATTATGATTGCTTTCTAT
CTGTTTACAACGACCAAGTTGAATTGGTTGAAAGTATTCTGTGTGATTGCAGGCTTTGTTAATTCTCTTTGGTTTGAA
CTTTACTCAAAATCGAACTGCCTTTCCTGCTATTATCGCTGGAGCAATTATCTATCTCTTTACGACTATTAAAAACT
GGAAGGCCTTTTGGCTTAGTATTGGGGTCTTCGCGATTGGTTTGAGTTTCCTCTTTTCTAGTGATTTGGGAGTTCGA
ATGGGTACTTTAGACTCTTCTATGGAAGAACGCATTTCTATCTGGGATGCTGGGATGGCCTTGTTTAAGCAAAATC
CTTTTTGGGGTGAAGGGCCATTGACCTATATGAACTCTTATCCTCCGGATACATGCTCCTTATCATGAACATGCCCA
CAGTCTTTATATTGATACGATTCTGAGTTACGGAATTGTGGGGACTATTTTATTAGTTTTGTCTTCTGTTGCTCCTG
TTCGCTTGATGATGGATATGAGTCAGGAGTCGGGGAAACGTCCGATTATCGGCCTTTATCTATCTTTCCTTACAGT
GGGTTGCTGTGCACGGAATTTTTGACTTGGCTCTCTTCTGGATTCAGTCAGGCTTTATTTTCTTGCTAGTTATGTGCA
GTATTCCATTGGAGCATCGAATGTTGGTATCGGACATGACGGATTAA 4120.1 (SEQ. ID. NO. 229)
ATGTCAAAGATGGATGTTCAGAAAATCATTGCACCGATGATGAAGTTTGTGAATATGCGTGGCATTATAGCTCTAA
AAGATGGGATGTTAGCAATTTTGCCATTGACAGTAGTTGGTAGTTTGTTCTTGATTATGGGACAATTGCCGTTCGA
AGGATTAAATAAGAGCATTGCTAGTGTTTTTGGAGCTAATTGGACAGAGCCGTTTATGCAAGTATATTCAGGAACT
TTTGCTATTATGGGTCTAATTTCTTGTTTTTCAATTGCCTATTCTTATGCTAAGAATAGCGGCGTAGAGGCTTTACC
AGCTGGACTTCTATCTGTATCTGCATTCTTTATTTTGCTAAGATCATCTTATATCCCTAAACAAGGTGAGGCGATTG
GGGACGCTATTAGTAAAGTTTGGTTTGGAGGCCAAGGAATTATCGGTGCTATCATTATAGGTTTGGTAGTAGGAAG
TATTTATACCTTCTTTATAAAGAGAAAAATTGTTATTAAGATGCCAGAACAAGTTCCACAAGCTATTGCCAAACAG
TTTGAAGCAATGATTCCAGCATTTGTAATTTTCTTATCTTCATGATTGTATATATTTTAGCGAAGTCATTGACTAA
TGGCGGAACATTCATAGAAATGATTTATTCTGCTATTCAAGTTCCGTTGCAAGGTTTAACTGGATCTTTGTATGGT
GCTATTGGAATTGCATTCTTTATATCATTTTTGTGGTGGTTTGGTGTTCATGGGCAATCGGTAGTAAATGGAGTAGT
GACAGCTCTGCTTTTATCTAATCTTGATGCTAATAAAGCTATGTTAGCCTCTGCTAATCTATCATTAGAAAATGGT
GCACATATTGTTACTCAACAATTTTTAGATTCATTTTTAATTCTATCAGGTTCAGGGATTACGTTTGGTCTTGTAGT
TGCCATGCTTTTTGCAGCAAAATCAAAACAATACCAAGCCTTAGGAAAAGTTGCAGCTTTTCCAGCAATATTTAAC
GTAAATGAGCCAGTTGTATTTGGATTTCCGATTGTCATGAATCCAGTTATGTTTGTACCTTTCATTCTTGTTCCTGT
ACTTGCAGCTGTGATAGTATATGGAGCTATTGCAACAGGTTTCATGCAGCCATTCTCAGGGGTAACATTGCCTTGG
AGTACACCAGCTATTTTATCAGGATTTTTGGTGGGTGGATGGCAAGGAGTTATTACTCAGCTGGTGATATTAGCGA
TGTCTACATTGGTTTATTTTCCATTCTTTAAAGTACAGGATCGTTTAGCTTACCAAAATGAAATCAAACAATCTTAG 4121.2 (SEQ. ID. NO. 230)
ATGAAGAAAAAGGACTTAGTAGACCAACTAGTCTCAGAGATCGAGACGGGGAAAGTCAGGACACTGGGAATATA
CGGTCATGGAGCTTCAGGTAAATCAACCTTTGCACAGGAATTGTACCAAGCTTTAGATTCTACTACAGTAAATTTG
CTAGAGACAGATCCTTATATCACCTCAGGACGCCATCTGGTACTACCCAAGGACGCGCCGAATCAAAAGGTGACA
GCCAGTCTGCCAGTGGCGCATGAACTGGAGAGTTTGCAGAGAGATATCCTTgCTTGCAGGCGGGTATGGATGTCTT
GA 4122.1 (SEQ. ID. NO. 231)
ATGAAGAAAAGATACCTAGTCTTGACAGCTTTGCTAGCCTTGAGTCTAGCAGCTTGTTCACAAGAAAAAACAAAA
AATGAAGATGGAGAAACTAAGACAGAACAGACAGCCAAAGCTGATGGAACAGTCGGTAGTAAGTCTCAAGGAGC
TGCCCAGAAGAAAGCAGAAGTGGTCAATAAAGGTGATTACTACAGCATTCAAGGGAAATACGATGAAATCATCGT
AGCCAACAAACACTATCCATTGTCTAAAGACTATAATCCAGGGGAAAATCCAACAGCCAAGGCAGAGTTGGTCAA
ACTCATCAAAGCGATGCAAGAGGCAGGTTTCCCTATTAGTGATCATTACATTACAGTGGTTTTAGAAGTTATGAAAACTCAG
ACCAAGCTCTATCAAGATTATGTCAACCAAGATGGAAAGGCAGCAGCTGACCGTTACTCTGCCCGTCCTGGCTAT
AGCGAACACCAGACAGGCTTGGCCTTTGATGTGATTGGGACTGATGGTGATTTGGTGACAGAAGAAAAGCAGCC
CAATGGCTCTTGGATCATGCAGCTGATTATGGCTTTGTTGTCCGTTATCTCAAAGGCAAGGAAAAGGAAACAGGCT
ATATGGCTGAAGAATGGCACCTGCGTTATGTAGGAAAAGAAGCTAAAGAAATTGCTGCAAGTGGTCTCAGTTTGG
AAGAATACTATGGCTTTGAAGGCGGAGACTACGTCGATTAA 4125.6 (SEQ. ID. NO. 232)
ATGCGTAAATTCTTAATTATTTTGTTGCTACCAAGTTTTTTGACCATTTCAAAAGTCGTTAGCACAGAAAAAGAAG
TCGTCTATACTTCGAAAGAAATTTATTACCTTTCACAATCTGACTTTTGGTATTTATTTTAGAGAAAAATTAAGTTCT
CCCATGGTTTATGGAGAGGTTCCTGTTTATGCGAATGAAGATTTAGTAGTGGAATCTGGGAAATTGACTCCCAAAA
CAAGTTTTCAAATAACCGAGTGGCGCTTAAATAAACAAGGAATTCCAGTATTTAAGCTATCAAATCATCAATTTAT
AGCTGCGGACAAACGATTTTTATATGATCAATCAGAGGTAACTCCAACAATAAAAAAAGTATGGTTAGAATCTGA
CTTTAAACTGTACAATAGTCCTTATGATTTAAAAGAAGTGAAATCATCCTTATCAGCTTATTCGCAAGTATCAATC
GACAAGACCATGTTTGTAGAAGGAAGAGAATTTCTACATATTGATCAGGCTGGATGGGTAGCTAAAGAATCAACT
TCTGAAGAAGATAATCGGATGAGTAAAGTTCAAGAATGTTATCTGAAAAATATCAGAAAGATTCTTTCTCTATTT
ATGTTAAGCAACTGACTACTGGAAAAGAAGCTGGTATCAATCAAGATGAAAAGATGTATGCAGCCAGCGTTTTGA
AACTCTCTTATCTCTATTATACGCAAGAAAAAATACAATGAGGGTCTATTTTTAGAAAAAATGGACTGTAAAATACGT
ATCTGCAGTCAATGATTTTCCAGGTTCTTATAAACCAGAGGGAAGTGGTAGTCTTCCTAAAAAAGAAGATAATAA
AGAATATTCTTTAAAGGATTTAATTACAAAGTATCAAAAGAATCTGATAATGTAGCTCATAATCTATTGGGATAT
TACATTTCAAACCAATCTGATGCCACATTCAAATCCAAGATGTCTGCCATTATGGGAGATGATTGGGATCCAAAAG
AAAAATTGATTCTTCTAAGATGGCCGGGAAGTTTATGGAAGCTGTATTTATAATCAAAATGGATTTGTGCTAGAGTC
TTTGACTAAAACAGATTTTGATAGTCAGCGAATTGCCAAAGGTGTTTCTGTTAAAGTAG
CTCATAAAATTGGAGATGCGGATGAATTTAAGCATGATACGGGTGTTGTCTATGCAGATTCTCCATTTATTCTTTCT
ATTTTCACTAAGAATTCTGATTATGATACGATTTCTAAGATAGCCAAGGATGTTTATGAGGTTCTAAAATGA 4125.7 (SEQ. ID. NO. 233)
ATGAAAAACAAAATAATGGTTTAATTAAAAATCCTTTTCTATGGTTATTATTTATCTTTTTCCTTGTGACAGGATT
CCAGTATTTCTATTCTGGGAATAACTCAGGAGGAAGTCAGCAAATCAACTATACTGAGTTGGTACAAGAAATTAC
CGATGGTAATGTAAAAGAATTAACTTACCAACCAAATGGTAGTGTTATCGAAGTTTCTGGTGTCTATAAAAATCCT
AAAACAAGTAAAGAAGAAACAGGTATTCAGTTTTTCACGCCATCTGTTACTAAGGTAGAGAAATTTACCAGCACT TABLE 1-continued ATTCTTCCTGCAGATACTACCGTATCAGAATTGCAAAAACTTGCTACTGACCATAAAGCAGAAGTAACTGTTAAGC
ATGAAAGTTCAAGTGGTATATGGATTAATCTACTCGTATCCATTGTGCCATTTGGAATTCTATTCTTCTTCCTATTC
TCTATGATGGGAAATATGGGAGGAGGCAATGGCCGTAATCCAATGAGTTTTGGACGTAGTAAGGCTAAAGCAGCA
AATAAAGAAGATATTAAAGTAAGATTTTCAGATGTTGCTGGGACGTGAGGAAGAAAAACAAGAACTAGTTGAAGTT
GTTGAGTTCTTAAAAGATCCAAAACGATTCACAAAACTTGGAGCCCGTATTCCAGCAGGTGTTCTTTTGGAGGGAC
CTCCGGGGACAGGTAAAACTTTGCTTGCTAAGGCAGTCGCTGGAGAAGCAGGTGTTCCATTCTTTAGTATCTCAGG
TTCTGACTTTGTAGAAATGTTTGTCGGAGTTGGAGCTAGTCGTGTTCGCTCTCTTTTTGAGGATGCCAAAAAAGCA
GCACCAGCTATCATCTTTATCGATGAAATTGATGCTGTTGGACGTCAACGTGGAGTCGGTCTCGGCGGAGGTAATG
ACGAACGTGAACAAACCTTGAACCAACTTTTTGATTGAGATGGATGGTTTTGAGGGAAATGAAGGGATTATCGTCA
TCGCTGCGACAAACCGTTCAGATGTACTTGACCCTGCCCTTTTGCGTCCAGGACGTTTTGATAGAAAAGTATTGGT
TGGTCGTCCTGATGTTAAAGGTCGTGAAGCAATCTTGAAAGTTCACGCTAAGAATAAGC
CTTTAGCAGAAGATGTTGATTTGAAATTAGTGGCTCAACAAACTCCAGGCTTTGTTGGTGCTGATTTAGAGAATGT
CTTGAATGAAGCAGCTTTAGTTGCTGCTCGTCGCAATAAATCGATAATTGATGCTTCAGATATTGATGAAGCAGAA
GATAGAGTTATTGCTGGACCTTCTAAGAAAGATAAGACAGTTTCACAAAAAGAACGAGAATTGGTTGCTTACCAT
GAGGCAGGACATACCATTGTTGGTCTAGTCTTGTCGAATGCTCGCGTTGTCCATAAGGTTACAATTGTACCACGCG
GCCGTGCAGGCGGATACATGATTGCACTTCCTAAAGAGGATCAAATGCTTCTATCTAAAGAAGATATGAAAGAGC
AATTGGCTGGCTTAATGGGTGGACGTGTAGCTGAAGAAATTATCTTTAATGTCCAAACCACAGGAGCTTCAAACG
ACTTTGAACAAGCGACACAAATGGCACGTGCAATGGTTACAGAGTACGGTATGAGTGAAAAACTTGGCCCAGTAC
AATATGAAGGAAACCATGCTATGCTTGGTGCACAGAGTCCTCAAAAATCAATTTCAGAACAAACAGCTTATGAAA
TTGATGAAGAGGTTCGTTCATTATTAAATGAGGCACGAAATAAAGCTGCTGAAATTATTCAGTCAAATCGTGAAAC
TCACAAGTTAATTGCAGAAGCATTATTGAAATACGAAACATTGGATAGTACACAAATTAAAGCTCTTTACGAAAC
AGGAAAGATGCCTGAAGCAGTAGAAGAGGAATCTCATGCACTATCCTATGATGAAGTAAAGTCAAAAATGAATGA
CGAAAAATAA 4125.10                                                                     (SEQ. ID. NO. 234)
ATGAGGGAACCAGATTTTTTAAATCATTTTCTCAAGAAGGGATATTTCAAAAAGCATGCTAAGGCGGTTCTAGCTC
TTTCTGGTGGATTAGATTCCATGTTTCTATTTAAGGTATTGTCTACTTATCAAAAAGAGTTAGAGATTGAATTGATT
CTAGCTCATGTGAATCATAAGCAGAGAATTGAATCAGATTGGGAAGAAAAGGAATTAAGGAAGTTGGCTGCTGAA
GCAGAGCTTCCTATTTATATCAGCAATTTTTCAGGAGAATTTTCAGAAGCGCGTGCACGAAATTTTCGTTATGATT
TTTTTCAAGAGGTCATGAAAAAGACAGGTGCGACAGCTTTAGTCACTGCCCACCATGCTGATGATCAGGTGGAAA
CGATTTTTATGCGCTTGATTCGAGGAACTCGCTTGCGCTATCTATCAGGAATTAAGGAGAAGCAAGTAGTCGGAGA
GATAGAAATCATTCGTCCCTTCTTGCATTTTCAGAAAAAAGACTTTCCATCAATTTTTCACTTTGAAGATACATCA
AATCAGGAGAATCATTATTTTCGAAATCGTATTCGAAATTCTTACTTACCAGAATTGGAAAAGAAAATCCTCGAT
TTAGGGATGCAATCTTAGGCATTGGCAATGAAATTTTAGATTATGATTTGGCAATAGTCGAATTATCTAACAATAT
TAATGTGGAAGATTTACAGCAGTTATTTTCTTACTCTGAGTCTACACAAAGAGTTTTACTTCAAACTTATCTGAATC
GTTTTCCAGATTTGAATCTTACAAAAGCTCAGTTTGCTGAAGTTCAGCAGATTTTAAAATCTAAAAGCCAGTATCG
TCATCCGATTAAAAATGGCTATGAATTGATAAAAGAGTACCAACAGTTTCAGATTTGTAAAATCAGTCCGCAGGCT
GATGAAAAGGAAGATGAACTTGTGTTACACTATCAAAATCAGGTAGCTTATCAAGGATATTTATTTTCTTTTGGAC
TTCCATTAGAAGGTGAATTAATTCAACAAATACCTGTTTCACGTGAAACATCCATACACATTCGTCATCGAAAAAC
AGGAGATGTTTTGATTAAAAATGGGCATAGAAAAAAACTCAGACGTTTATTTATTG
ATTTGAAAATCCCTATGGAAAAAGAAACTCTGCTCTTATTATTGAGCAATTTGGTGAAATTGTCTCAATTTTGGG
AATTGCGACCAATAATTTGAGTAAAAAAACGAAAAATGATATAATGAACACTGTACTTTATATAGAAAAAATAGA
TAGGTAA 4126.1                                                                      (SEQ. ID. NO. 235)
ATGAAGCGTTCTTCTCTTTTAGTTAGAATGGTTATTTCCATCTTTCTGGTCTTTCTCATTCTCCTAGCTCTGGTTGGA
ACTTTCTACTATCAATCAAGTTCTTCAGCCATTGAGGCCACCATTGAGGGCAACAGCCAAACGACCATCAGCCAG
ACTAGCCACTTTATTCAGTCTTATATCAAAAAACTAGAAACCACCTCGACTGGTTTGACCCAGCAGACGGATGTTC
TGGCCTATGCTGAGAATCCCAGTCAAGACAAGGTCGAGGGAATCCGAGATTTGTTTTTGACCATCTTGAAGTCAGA
TAAGGACTTGAAAACTGTTGTGCTGGTGACCAAATCTGGTCAGGTCATTTCTACAGATGCAGTGTGCAGATGAA
AACTTCCTCTGATATGATGGCTGAGGATTGGTACCAAAAGGCCATTCATCAGGGAGCTATGCCTGTTTTGACTCCA
GCTCGTAAATCAGATAGTCAGTGGGTCATTTCTGTCACTCAAGAACTTGTTGATGCAAAGGGAGCCAATCTTGGTG
TGCTTCGTTTGGATATTTCTTATGAAACTCTGGAAGCCTATCTCAATCAACTCCAGTTGGGGCAGCAGGGCTTTGC
CTTCATTATCAATGAAAACCATGAATTTGTCTACCATCCTCAACACACAGTTTATAGTTCGTCTGCTAGCAAAATGGAG
GCTATGAAACCCTACATCGATACAGGTCAGGGTTATACTCCTGGTCACAAATCCTACGTCAGTCAAGAGAAGATT
GCAGGAACTGATTGGACGGTGCTTGGCGTGTCATCATTGGAAAAGTTAGACCAGGTTCGGAGTCAGCTCTTGTGG
ACCTTGCTTGGGGCCAGTGTCACATCTCTTCTTGTCTGTCTCTGCTTAGTGTGGTTCAGTCTTAAACGCTGGATTGC
TCCTTTGAAGGATTTGAGAGAAACCATGTTGGAAATTGCTTCTGGCTTTCAAATCTTCGTGCCAAGGAAGTTGGT
GCCTATGAACTGAGAGAAGTAACTCGCCAATTTAATGCTATGTTGGATCAGATTGATCAGTTGATGGTAGCTATTC
GTAGCCAGGAAGAAACGACCCGTCAGTACCAACTTCAAGCCCTTTCGAGCCAGATTAATCCACATTTCCTCTATAA
CACTTTGGACACCATCATCTGGATGGCTGAATTTCATGATAGTCAGCGAGTGGTGCAGGTGACCAAGTCCTTGGCA
ACCTATTTCCGCTTGGCGCTCAATCAAGGCAAGGACTTGATTTGTCTCTGACGAAATCAATCATGTCCGCCAGT
ATCTCTTTATCCAGAAACAACGCTATGGAGATAAGCTTGGAATACGAAATTAATGAAAATGTTGCCTTTGATAATTT
AGTCTTACCCAAGCTGGTCCTACAACCCCTTGTAGAAAATGCTCTTTACCATGGCATTAAGGAAAAGGAAGGTCA
GGGCCATATTAAACTTTCTGTCCAGAAACAGGATTCGGGATTGGTCATCCGTATTGAGGATGATGGCGTTGGCTTC
CAAGATGCTGGTGATAGTAGTCAAAGTCAACTCAAACGTGGGGGAGTTGGTCTTCAAAATGCGATCAACGGCTC
AAACTTCATTTTGGAGCCAATTACCATATGAAGATTGATTCTAGACCCCAAAAAGGGACGAAAGTTGAAATATAT
ATAAATAGAATAGAAACTAGCTAA 4126.7                                                                      (SEQ. ID. NO. 236)
ATGAAGCGTTCTTCTCTTTTAGTTAGAATGGTTATTTCCATCTTTCTGGTCTTTCTCATTCTCCTAGCTCTGGTTGGA
ACTTTCTACTATCAATCAAGTTCTTCAGCCATTGAGGCCACCATTGAGGGCAACAGCCAAACGACCATCAGCCAG
ACTAGCCACTTTATTCAGTCTTATATCAAAAAACTAGAAACCACCTCGACTGGTTTGACCCAGCAGACGGATGTTC
TGGCCTATGCTGAGAATCCCAGTCAAGACAAGGTCGAGGGAATCCGAGATTTGTTTTTGACCATCTTGAAGTCAGA
TAAGGACTTGAAAACTGTTGTGCTGGTGACCAAATCTGGTCAGGTCATTTCTACAGATGCAGTGTGCAGATGAA
AACTTCCTCTGATATGATGGCTGAGGATTGGTACCAAAAGGCCATTCATCAGGGAGCTATGCCTGTTTTGACTCCA
GCTCGTAAATCAGATAGTCAGTGGGTCATTTCTGTCACTCAAGAACTTGTTGATGCAAAGGGAGCCAATCTTGGTG
TGCTTCGTTTGGATATTTCTTATGAAACTCTGGAAGCCTATCTCAATCAACTCCAGTTGGGGCAGCAGGGCTTTGC
CTTCATTATCAATGAAAACCATGAATTTGTCTACCATCCTCAACACACAGTTTATAGTTCGTCTAGCAAAATGGAG TABLE 1-continued

```
GCTATGAAACCCTACATCGATACAGGTCAGGGTTATACTCCTGGTCACAAATCCTACGTCAGTCAAGAGAAGATT
GCAGGAACTGATTGGACGGTGCTTGGCGTGTCATCATTGGAAAAGTTAGACCAGGTTCGGAGTCAGCTCTTGTGG
ACCTTGCTTGGGGCCAGTGTCACATCTCTTCTTGTCTGTCTCTGCTTAGTGTGGTTCAGTCTTAAACGCTGGATTGC
TCCTTTGAAGGATTTGAGAGAAACCATGTTGGAAATTGCTTCTGGTGCTCAAAATCTTCGTGCCAAGGAAGTTGGT
GCCTATGAACTGAGAGAAGTAACTCGCCAATTTAATGCTATGTTGGATCAGATTGATCAGTTGATGGTAGCTATTC
GTAGCCAGGAAGAAACGACCCGTCAGTACCAACTTCAAGCCCTTTCGAGCCAGATTAATCCACATTTCCTCTATAA
CACTTTGGACACCATCATCTGGATGGCTGAATTTCATGATAGTCAGCGAGTGGTGCAGGTGACCAAGTCCTTGGCA
ACCTATTTCCGCTTGGCGCTCAATCAAGGCAAGGACTTGATTTGTCTCTCTGACGAAATCAATCATGTCCGCCAGT
ATCTCTTTATCCAGAAAACAACGCTATGGAGATAAGCTGGAATACGAAATTAATGAAAATGTTGCCTTTGATAATTT
AGTCTTACCCAAGCTGGTCCTACAACCCCTTGTAGAAAATGCTCTTTACCATGGCATTAAGGAAAAGGAAGGTCA
GGGCCATATTAAACTTTCTGTCCAGAAACAGGATTCGGGATTGGTCATCCGTATTGAGGATGATGGCGTTGGCTTC
CAAGATGCTGGTGATAGTAGTCAAAGTCAACTCAAACGTGGGGGAGTTGGTCTTCAAAATGTCGATCAACGGCTC
AAACTTCATTTTGGAGCCAATTACCATATGAAGATTGATTCTAGACCCCAAAAAGGGACGAAAGTTGAAATATAT
ATAAATAGAATAGAAACTAGCTAA
```

4127.4 (SEQ. ID. NO. 237)
```
ATGTTTTTTAAATTATTAAGAGAAGCTCTTAAAGTCAAGCAGGTTCGATCAAAAATTTTATTTACAATTTTTATCGT
TTTGGTCTTTCGTATCGGAACTAGCATTACAGTTCCTGGTGTGAATGCCAATAGCTTGAATGCTTTAAGTGGATTAT
CCTTCTTAAACATGTTGAGCTTGGTGTCGGGGAATGCCCTAAAAAACTTTTCGATTTTTGCCCTAGGAGTTAGTCC
CTATATCACCGCTTCTATTGTTGTCCAACTCTTGCAAATGGATATTTTACCCAAGTTTGTAGAGTGGGGTAAACAA
GGGGAAGTAGGTCGAAGAAAATTGAATCAAGCTACTCGTTATATTGCTCTAGTTCTCGCTTTTTGTGCAATCTATCG
GGATTACAGCTGGTTTTAATACCTTGGCTGGAGCTCAATTGATTAAAACTGCTTTAACTCCACAAGTTTTTCTGAC
GATTGGTATCATCTTAACAGCTGGTAGTATGATTGTCACTTGGTTGGGTGAGCAAATTACAGATAAGGGATACGGA
AACGGTGTTTCCATGATTATCTTTGCCGGGATTGTTTCCTCAATTCCAGAGATGATTCAGGGCATCTATGTGGACT
ACTTTGTGAACGTCCCAAGTAGCCGTATCACTTCATCTATCATTTCGTAATCATTTTGATTATTACTGTATTGTTG
ATTATTTACTTTACAACTTATGTTCAACAAGCAGAATACAAAATTCCAATCAATATACTAAGGTTGCACAAGGTG
CTCCATCTAGCTCTTACCTTCCGTTAAAAGTAAACCCTGCTGGAGTTATCCCTGTTATCTTTGCCAGTTCGATTACT
GCAGCGCCTGCGGCTATTCTTCAGTTTTTGAGTGCCACAGGTCATGATTGGGCTTGGGTAAGGGTAGCACAAGAGA
TGTTGGCAACTACTTCTCCAACTGGTATTGCCATGTATGCTTTGTTGATTATTCTCTTTACATTCTTCTATACGTTTG
TACAGATTAATCCTGAAAAAGCAGCAGAGACCTACAAAAGAGTGGTGCCTATATCCATGGAGTTCGTCCTGGTAA
AGGTACAGAAGAATATATGTCTAAACTTCTTCGTCGTCTTGCAACTGTTGGTTCCCTCTTCCTTGGTGTGA
```

4127.5 (SEQ. ID. NO. 238)
```
ATGGATATTAGACAAGTTACTGAAACCATCGCCATGATTGAGGAGCAAAACTTCGATATTAGAACCATTACCATG
GGGATTTCTCTTTTGGACTGTATCGATCCAGATATCAATCGTGCTGCGGAGAAAATCTATCAAAAAATTACGACAA
AGGCGGCTAAATTTAGTAGCTGTTGGTGATGAAATTGCGGCTGAGTTGGGAATTCCTATCGTTAATAAGCGTGTATC
GGTGACACCTATTTCTCTGATTGGGGCAGCGACAGATGCGACGACTACGTGGTTCTGCAAAAGCGCTTGATAA
GGCTGCGAAAGAGATTGGTGTGGACTTTATTGGTGGTTTTTCTGCCTTAGTACAAAAAGGTTATCAAAAGGGAGAT
GAGATTCTCATCAATTCCATTCCTCGCGCTTTGGCTGAGACGGATAAGGTCTGCTCGTCAGTCAATATCGGCTCAA
CCAAGTCTGGTATTAATATGACGGCTGTGGCAGATATGGGACGAATTATCAAGGAAACAGCAAATCTTTCAGATA
TGGGAGTGGCCAAGTTGGTTGTATTCGCTAATGCTGTTGAGGACAATCCATTTATGGCGGGTGCCTTTCATGGTGT
TGGGGAAGCAGATGTTATCATCAATGTCGGAGTTTCTGGTCCTGGTGTTGTGAAACGTGCTTTGGAAAAAGTTCGT
GGACAGAGCTTTGATCTAGTAGCCGAAACAGTTAAGAAAACTGCCTTTAAAATCACTCGTATCGGTCAATTGGTTG
GTCAAATGGCCAGTGAGAGACTGGGTGTGGAGTTTGGTATTGTGGACTTGAGTTTGGCACCAACCCCTGCGGTTGG
AGACTCTGTGGCACGTGTCCTTGAGGAAATGGGGCTAGAAACAGTTGGCACGCATGGAACGACGGCTGCCTTGGC
CCTCTTGAACGACCAAGTTAAAAAGGGTGGAGTGATGGCCTGCAACCAAGTCGGTGGTTTATCTGGTGCCTTTATC
CCTGTTTCTGAGGATGAAGGAATGATTGCTGCAGTGCAAAATGGCTCTCTTAATTTAGAAAAACTAGAAGCTATGA
CGGCTATCTGTTCTGTTGGATTGGATATGATTGCCATCCCAGAAGATACGCCTGCTGAAACTATTGCGGCTATGAT
TGCGGATGAAGCAGCAATCGGTGTTATCAACATGAAAACAACAGCTGTTCGTATCATTCCCAAAGGAAAAGAAGG
CGATATGATTGAGTTTGGTGGTCTATTAGGAACTGCACCCGTTATGAAGGTTAATGGGGCTTCGTCTGTCGACTTC
ATCTCTCGCGGTGGACAAATCCCAGCACCAATTCATAGTTTTAAAAATTAA
```

4128.1 (SEQ. ID. NO. 239)
```
ATGACACAGATTATTGATGGGAAAGCTTTAGCGGCCAAATTGCAGGGGCAGTTGGCTGAAAAGACTGCAAAATTA
AAGGAAGAAACAGGTCTAGTGCCTGGTTTGGTAGTGATTTTGGTTGGGGACAATCCAGCCAGCCAAGTCTACGTT
CGCAACAAGGAGAGGTCAGCCCTTGCGGCTGGTTTCCGTAGCGAAGTAGTACGGGTTCCAGAGACCATTACTCAA
GAGGAATTCTTAGACCTGATTGCTAAATACAATCAGGATCCAGCTTGGCATGGGATTTTGGTTCAGTTGCCATTAC
CAAAACACATTGATGAAGAGGCGGTTCTATTGGCTATTGACCCAGC=AAAAGGATGGATGGTTTCCATCCTCTAA
ACATGGGGCGTCTTTGGTCTGGTCATCCAGTCATGATTCCTTCGACACCGGCAGGAATTATGGAAATGTTCCATGA
ATATGGGATTGACT6TGGAAGGTAAAAATGCAGTCGTCATCGGTCGATCCAATATTGTCGGAAAACCTATGGCCCA
GCTTCTTTTGGCAAAGAATGCAACAGTAACCTTGACTCACTCACGTACTCATAATCTTTCCAAGGTGGCTGCAAAA
GCAGATATTCTGGTTGTTGCAATCGGTCGTGCCAAGTTTGTGACTGCTGACTTTGTCAAACCAGGTGCGGTAGTCA
TTGACGTTGGGATGAACCGCGATGAAAATGGTAAGCTCTGTGGGGATGTTGATTATGAGGCGGTTGCCCCACTTGC
TAGCCACATTACGCCAGTCCCTGGAGGTGTCGGTCCTATGACCATTACTATGCTGATGGAGCAAACCTATCAGGCA
GCACTTAGGACATTGGATAGAAAATAA
```

4128.2 (SEQ. ID. NO. 240)
```
ATGTCTAAATTTAATCGTATTCATTTGGTGGTACTGGATTCTGTAGGAATCGGTGCAGCACCAGATGCTAATAACT
TTGTCAATGCAGGGGTTCCAGATGGAGCTTCTGACACACTGGGACACATTTCAAAAACAGTTGGTTTGAATGTCCC
AAACATGGCTAAAATAGGTCTTGGAAATATTCCTCGTGAAACTCCTCTTAAGACTGTAGCAGCTGAAAGCAATCC
AACTGGATATGCAACAAAATTAGAGGAAGTATCTCTTGGTAAGGATACTATGACTGGACACTGGGAAATCATGGG
ACTCAACATTACTGAGCCTTTCGATACTTTCTGGAACGGATTCCCAGAAGAAATCCTGACAAAAATCGAAGAATTC
TCAGGACGCAAGGTTATTCGTGAAGCCAACAAACCTTATTCAGGAACGGCTGTTATCTATGATTTTGGACCACGTC
AGATGGAAACTGGAGAGTTGATTATCTATACTTCAGCTGACCCTGTTTTGCAGATTGCTGCCCACGAAGACATTAT
TCCTTTGGATGAATTGTACCGTATCTGTGAATACGCTCGTTCGATTACCCTTGAGCGTCCTGCCCTTCTTGGTCGCA
TCATTGCTCGCCCTTATGTAGGTGAACCAGGTAACTTCACTCGTACGGCAAACCGTCGTGACTTGGCTGTATCTCC
ATTTTTCCCAACTGTTTTGGATAAATTGAATGAGGCTGGTATCGATACTTATGCTGTGGGTAAAATCAACGATATC
TTTAACGGTGCTGGTATCAACCATGACATGGGTCACAACAAGTCAAATAGTCATGGAATTGATACACTATTGAAG
ACTATGGGACTTGCTGAGTTTGAAAAAGGATTCTCATTCACAAACCTAGTTGACTTTGATGCCCTTTACGGCCATC
```

TABLE 1-continued

```
GTCGTAATGCTCACGGTTACCGTGATTGCTTGCATGAGTTTGATGAACGCTTACCTGAAATTATCGCAGCTATGAG
AGAGAATGACCTTCTCTTGATTACTGCGGACCATGGAAATGACCCAACGTATGCAGGAACGGATCACACTCGGGA
ATATATTCCATTGTTGGCCTATAGCCCTGCCTTTAAAGGAAATGGTCTCATTCCAGTAGGACATTTTGCAGATATTT
CAGCGACTGTTGCCGATAACTTTGGTGTGGAAACTGCTATGATTGGGGAAAGTTTCTTAGATAAATTGGTATAA
```

4129.2 (SEQ. ID. NO. 241)
```
ATGTTTATTTCCATCAGTGCTGGAATTGTGACATTTTTACTAACTTTAGTAGAAATTCCGGCCTTTATCCAATTTTA
TAGAAAGGCGCAAATTACAGGCCAGCAGATGCATGAGGATGTCAAACAGCATCAGGCAAAAGCTGGGACTCCTA
CAATGGGAGGTTTGGTTTTCTTGATTACTTCTGTTTTGGTTGCTTTCTTTTTCGCCCTATTTAGTAGCCAATTCAGCA
ATAATGTGGGAATGATTTTGTTCATCTTGGTCTTGTATGGCTTGGTCGGATTTTTAGATGACTTTCTCAAGGTCTTT
CGTAAAATCAATGAGGGGCTTAATCCTAAGCAAAAATTAGCTCTTCAGCTTCTAGGTGGAGTTATCTTCTATCTTT
TCTATGAGCGCGGTGGCGATATCCTGTCTGTCTTTGGTTATCCAGTTCATTTGGGATTTTTCTATATTTTCTTCGCT
CTTTTCTGGCTAGTCGGTTTTTCAAACGCAGTAAACTTGACAGACGGTGTTGACGGTTTAGCTAGTATTTCCGTTGT
GATTAGTTTGTCTGCCTATGGAGTTATTGCCTATGTGCCAGGTCAGATGGATATTCTTCTAGTAATTCTTGCCATGA
TTGGTGGTTTGCTCGGTTTCTTCATCTTTAACCATAAGCCTGCCAAGGTCTTTATGGGTGATGTGGGAAGTTTGGCC
CTAGGTGGGATGCTGGCAGCTATCTCTATGGCTCTCCACCAAGAATGGACTCTTCTTGATTATCGGAATTGTGTATG
TTTTTGAAACAACTTCTGTTATGATGCAAGTCAGTTATTTCAAACTGACAGGTGGTAAACGTATTTTCCGTATGAC
GCCTGTACATCACCATTTTGAGCTTGGGGGATTGTCTGGTAAAGGAAATCCTTGGAGCGAGTGGAAGGTTGACTTC
TTCTTTTGGGGAGTGGGACTTCTAGCAAGTCTCCTGACCCTAGCAATTTTATATTTGATGTAA
```

4133.1 (SEQ. ID. NO. 242)
```
TTGTTTAAGAAAAATAAAGACATTCTTAATATTGCATTGCCAGCTATGGGTGAAAACTTTTTGCAGATGCTAATGG
GAATGGTGGACAGTTATTTGGTTGCTCATTTAGGATTGATAGCTATTTCAGGGGTTTCAGTAGCTGGTAATATTAT
CACCATTTATCAGGCGATTTTCATCGCTCTGGGAGCTGCTATTTCCAGTGTTATTTCAAAAAGCATAGGGCAGAAA
GACCAGTCGAAGTTGGCCTATCATGTGACTGAGGCGTTGAAGATTACCTTACTATTAAGTTTCCTTTTAGGATTTTT
GTCCATCTTCGCTGGGAAAGAGATGATAGGACTTTTGGGGACGGAGAGGGATGTAGCTGAGAGTGGTGGACTGTA
TCTATCTTTGGTAGGCGGATCGATTGTTCTCTTAGGTTTAATGACTAGTCTAGGAGCCTTGATTCGTGCAACGCAT
AATCCACGTCTGCCTCTCTATGTTAGTTTTTTATCCAATGCCTTGAATATTCTTTTTTCAAGTCTAGCTATTTTTGTT
CTGGATATGGGGATAGCTGGTGTTGCTTGGGGGACAATTGTGTCTCGTTTGGTTGGTCTTGTGATTTTGTGGTCAC
AATTAAAACTGCCTTATGGGAAGCCAACTTTTGGTTTAGATAAGGAACTGTTGACCTTGGCTTTACCAGCAGCTGG
AGAGCGACTTATGATGAGGGCTGGAGATGTAGTGATCATTGCCTTGGTCGTTTCTTTTGGGACGGAGGCAGTTGCT
GGGAATGCAATCGGAGAAGTCTTGACCCAGTTTAACTATATGCCTGCCTTTGGCGTCGCTACGGCAACGGTCATGC
TGTTGGCCCGAGCAGTTGGAGAGGATGATTGGAAAAGAGTTGCTAGTTTGAGTAAACAAACCTTTTGGCTTTCTCT
GTTCCTCATGTTGCCCCTGTCCTTTAGTATATATGTCTTGGGTGTACCATTAACTCATCTCTATACGACTGATTCTC
TAGCCGGTGGAGGCTAGTGTTCTAGTGACACTGTTTTCACTACTTGGGACCCCTATGACGACAGGAACAGTCATCTA
TACGGCAGTCTGGCAGGGATTAGGAAATGCACGCCTCCCTTTTTATGCGACAAGTATAGGAATGTGGTGTATCCGC
ATTGGGACAGGATATCTGATGGGATTGTGCTTGGTTGGGGCTTGCCTGGTATTTGGCAGGGTCTCTCTTGGATA
ATGGTTTTCGCTGGTTATTTCTACGCTATCGTTACCAGCGCTATATGAGCTTGAAAGGATAG
```

4135.2 (SEQ. ID. NO. 243)
```
ATGCAAACCAAGAAAAACACTCGCAAGCAGCCGTTCTTGGCTTGCAGCACTTACTAGCCATGTACTCAGGATCT
ATCCTGGTTCCCATCATGATTGCGACAGCCCTTGGCTATTCAGCTGAGCAGTTGACCTACCTGATTTCTACAGATA
TCTTCATGTGTGGGGTGGCAACCTTCCTCCAACTCCAACTCAACAAATACTTTGGGATTGGACTCCCAGTCGTTCT
TGGAGTTGCATTCCAGTCGGTCGCTCCCTTGATTATGATTGGGCAAAGCCATGGTAGTGGCGCTATGTTTGGTGCC
CTTATCGCATCTGGGATTTACGTGGTTCTTGTTTCAGGCATCTTCTCAAAAGTAGCCAATCTCTTCCCCATCTATCGT
AACAGGATCTGTTATTACCACGATTGGTTTAACCTTGATCCCTGTCGCTATTGGAAATATGGGAAATAACGTTCCA
GAGCCAACTGGTCAAAGTCTCCTTGCTGCAGCTATTACTGTTCTGATTATCCTCTTGATCAACATCTTTACCAAAG
GATTTATCAAGTCTATCTCTATTTTGATTGGTCTGGTTGTTGGAACTGCCATTGCTGCTACTATGGGCTTGGTGGAC
TTCTCTCCTGTTGCGGTAGCTCCACTTGTCCATGTCCCAACTCCACTCTACTTTGGGATGCCAACCTTTGAAATCTC
ATCTATTGTCATGATGTGTATCATCGCAACGGTGTCTATGGTTGAGTCAACCTGGTGTTTATCTGGCCTTGTCTGATA
TCACAAAGGAATCCAATCGACAGCACGCGCCTTCGCAACGGATACCGCGCAGAAGGTTTGGCCGTACTTCTCGGAG
GAATCTTTAACACCTTCCCTTACACCGGATTTTCACAAAACGTTGGTTTGGTTAAATTGTCAGGCATCAAAAAACG
CCTGCCAATCTACTACGCAGCTGGTTTCCTGGTTCTCCTTGGACTGCTTCCTAAGTTTGGCGCCCTTGCCCAAATCA
TTCCAAGCTCCGTCCTCGGTGGTGCCATGCTGGTAATGTTTGGTTTTGTATCAATTCAAGGGATGCAAATCCTCGC
CCGTGTTGACTTTGCTAACAATGAACACAACTTCCTTATCGCAGCTGTTTCAATCGCTGCAGGTGTCGGTCTCAAC
AACAGTAATCTCTTTGTCAGCATGCCGACAGCCTTCCAAATGTTCTTCTCAAACGGAATCGTCGTAGCCAGCCTAC
TCGCTATTGTCCTCAATGCCGTATTAAATCATAAAAAGAAATAA
```

4136.2 (SEQ. ID. NO. 244)
```
ATGAAAGATAGAATAAAAGAATATTTACAAGACAAGGGAAAGGTGACTGTTAATGATTTGGCTCAGGCTTGGGA
AAAGACAGTTCCAAGGATTTTCGTGAGTTGATTAAAACCTTGTCCTTAATGGAAAGAAAGCACCAAATTCGTTTTG
AAGAAGATGGTAGTCTGACATTAGAAATTAAGAAAAAACATGAAGATTACCCTCAAGGGGATTTTTCATGCCCATA
AAAATGGCTTTGGCTTTGTTAGTCTGGAAGGCGAGGAGGACGACCTTTTTGTAGGGAAAAATGATGTCAACTATGC
TATTGATGGTGATACCGTCGAGGTAGTGATTAAGAAAGTCGCTGACCGCAATAAGGGAACAGCAGCAGAAGCCAA
AATTATTGATATCCTAGAACACAGTTTGACAACAGTTGTCGGGCAAATCGTTCTGGATCAGGAAAAACCTAAGTAT
GCTGGCTATATTCGTTCAAAAAATCAGAAAATCAGTCAACCGATTTATGTTAACAAACCAGCCCTAAAATTAGAA
GGAACAGAAGTTCTCAAAGTCTTTATCGATAAAATACCCAAGCAAGAAACATGATTTCTTTGTCGCGAGTGTTCTCG
ATGTAGTGGGACACTCAACGGATGTCGGAATTGATGTTCTTGAGGTCTTGGAATCAATGGACATTGTATCCGAGTT
TCCAGAAGCTGTTGTTAAGGAAGCAGAAAGTGTGCCTGATGCTCCGTCTCAAAAGGATATGGAAGGTCGTCTGGA
TCTAAGAGATGAAATTACCTTTACCATTGACGGTGCGGATGCCAAGGACTTGACGATGCAGTGCATATCAAGGC
TCTGAAAAATGGCAATCTGGAGTTTGGGGTTCACATCGCAGATGTTTCTTATTATGTGACCGAGGGGTCTGCCCTT
GACAAGGAAGCCCTTAACCGTGCGACTTCTGTTTACGTGACAGACCGAGTGGTGCCAATGCTTCCAGAACGACTA
TCAAATGGCATCTGCTCTCTCAATCCCCAAGTTGACCGCCTGACCCAGTCTGCTATTAT
GGAGATTGATAAACATGGTCGTGTGGTCAACTATACCATTACACAAACAGTTATCAAGACCAGTTTTCGTATGACC
TATAGCCGATGTCAATGATATCCTAGCTGGCGATGAAGAAAAGAGAAAAGAATATCATAAAATTGTATCAAGTATC
GAACTCATGGCCAAGCTTCATGAAACTTTAGAAAACATGCGTGTGAAACGTGGAGCTCTCAATTTTGATACCAATG
AAGCGAAGATTTTAGTGGATAAACAAGGTAAGCCTGTTGATATCGTTCTTCGGCAGCGTGGTATTGCCGAGCGGA
TGATTGAGTCTTTTATGTTGATGGCTAATGAAACAGTTGCCGAACATTTCAGCAAGTTGGATTTGCCTTTTATCTAT
CGAATTCACGAGGAGCCTAAGGCTGAAAAGGGTTCAGAAGTTTATTGATTATGCTTCGAGTTTTGGCTTGCGCATTT
```

TABLE 1-continued

ATGGAACTGCCAGTGAGATTAGTCAGGAGGCACTTCAAGACATCATGCGTGCTGTTGAGGGAGAACCTTATGCAG
ATGTATTGTCCATGATGCTTCTTCGCTCTATGCAGCAGGCTCGTTATTCGGAGCACAATCACGGCCACTATGGACT
AGCTGCTGACTATTATACTCACTTTACCAGTCCAATTCGTCGTTATCCAGACCTTCTTGTTCACCGTATGATTCGGG
ATTACGGCCGTTCTAAGGAAATAGCAGAGCATTTTGAACAAGTGATTCCAGAGATTGCGACCCAGTCTTCCAACC
GTGAACGTCGTGCCATAGAAGCTGAGCGTGAAGTCGAAGCCATGAAAAGGCTGAGTATATGGAAGAATACGTGG
GTGAAGAGTATGATGCAGTTGTATCAAGTATTGTCAAATTCGGTCTCTTTGTCGAATTGCCAAACACAGTTGAAGG
CTTGATTCACATCACTAATCTGCCTGAATTTTATCATTTCAATGAGCGTGATTTGACTCTTCGTGGAGAAAAATCA
GGTATCACTTTCCGAGTGGGTCAGCAGATCCGTATCCGTGTTGAAAGAGCGGATAAAATGACTGGAGAGATTGAT
TTTTCATTCGTACCTAGTGAGTTTGATGTGATTGAAAAAGGCTTGAAACAGTCTAGTCGT
AGTGGCAGAGGGCGTGATTCAAATCGTCGTTCGGATAAGAAGGAAGACAAGAGAAAATCAGGACGCTCAAATGA
TAAGCGTAAGCATTCACAAAAAGACAAGAAGAAAAAAGGAAAGAAACCTTTTTCACCGGAAGTAGCTAAGAAAG
GAGCCAAGCATGGCAAAGGGCGAGGGAAAGGTCGTCGCACAAAATAA 4137.2                                                          (SEQ. ID. NO. 245)
ATGGGCACAACAGGATTTACAATAATTGACTTAATTATCTTGATTGTTTATTTACTTGCGGTGTTGGTTGCAGGTAT
CTATTTCTCTAAAAAAGAGATGAAAGGAAAAGAGTTCTTTAAAGGAGATGGTTCGGTTCCTTGGTATGTTACTTCG
GTATCCATTTTTGCCACAATGCTCAGTCCGATTTCCTTCTTGGGACTCGCTGGTAGCTCTTATGCAGGTAGCTGGAT
TTTATGGTTTGCTCAATTAGGGATGGTAGTAGCTATTCCACTGACAATTCGTTTTATCTTACCTATCTTTGCACGGA
TAGACATCGATACGGCATATGATTACTTGGATAAACGTTTTAATTCTAAAAGCACTTCGTATTATTTCAGCACTCTT
GTTTATTATTTATCAATTGGGACGTATGTCTATCATTATGTACCTCCCATCAGCTGGTTTATCAGTATTGACAGGAA
TTGACATCAATATTTTGATTATTTTGATGGGTGTAGTTGCAATTGTTTATTCTTATACTGGTGGTCTAAAATCCGTA
TTATGGACAGACTTTATTCAAGGTGTGATTCTGATTAGTGGTGTCGTTTTAGCTTTATTTGTACTGATTGCTAATAT
TAAAGGTGGCTTTGGTGCAGTAGCAGAAACATTAGCAAACGGGAAATTCCTTGCTGCAAATGAAAAACTTTTCGA
TCCTAACTTGCTTTCAAACTCCATCTTTTTTAATTGTGATGGGTTCAGGCTTTTACAATCTTGTCTTCCTATGCTTCATC
TCAAGATTTGGTTCAACGTTTTACTACAACACAAAATATTAAGAAACTTAATAAGATGTTGTTCACAAACGGTGTT
TTGTCACTTGCAACTGCAACAGTCTTTTACTTGATTGGTACAGGCTTGTACGTATTCTATCAAGTACAAAATGCAG
ATAGTGCAGCTAGCAATATCCCTCAAGACCAAATCTTTATGTACTTTATTGCATACCAGTTACCAGTAGGTATCAC
AGGTTTGATCTTGGCAGCGATTTATGCAGCATCTCAATCAACTATTTCAACAGGTTTGAACTCTGTTGCAACTTCA
TGGACATTGGATATTCAAGATGTCATTTCTAAAAATATGTCAGACAATCGTCGTACGAAAATTGCACAATTCGTAT
CTCTAGCAGTAGGTTTATTCTCAATTGGTGTTTCCATTGTCATGGCTCACTCAGATATTAAATCTGCATACGAATGG
TTCAATAGTTTCATGGGACTTGTACTTGGTCTACTTGGTGGTGTATTTATTCTTGGATTTGTTTCTAAAAAAGCAAA
TAAACAAGGTGCTTATGCAGCGCTGATTGTATCAACCATCGTCATGGTATTTATTAAATACTTCCTTCCTCCAACA
GCTGTTAGCTACTGGGCATATTCATTGATTTCAATCTCTGTATCAGTAGTTTCAGGTTATATTGTATCTGTTCTTAC
TGGAAATAAAGTATCTGCACCTAAATATACAACGATTCATGATATTACAGAAATTAAAGCGGATTCAAGTTGGGA
AGTTCGTCACTAA 4138.1                                                          (SEQ. ID. NO. 246)
ATGAAATTTAGTAAAAAATATATAGCAGCTGGATCAGCTGTTATCGTATCCTTGAGTCTATGTGCCTATGCACTAA
ACCAGCATCGTTCGCAGGAAAATAAGGACAATAATCGTGTCTCTTATGTGGATGGCAGCCAGTCAAGTCAGAAAA
GTGAAAACTTGACACCAGACCAGGTTAGCCAGAAAGAAGGAATTCAGGCTGAGCAAATTGTAATCAAAATTACAG
ATCAGGGCTATGTAACGTCACACGGTGACCACTATCATTACTATAATGGGAAAGTTCCTTATGATGCCCTCTTTAG
TGAAGAACTCTTGATGAAGGATCCAAACTATCAACTTAAAGACGCTGATATTGTCAATGAAGTCAAGGGTGGTTA
TATCATCAAGGTCGATGGAAATATTATGTCTACCTGAAAGATGCAGCTCATGCTGATAATGTTCGAACTAAAGAT
GAAATCAATCGTCAAAAACAAGAACATGTCAAAGATAATGAGAAGGTTAACTCTAATGTTGCTGTAGCAAGGTCT
CAGGGACGATATCTACGACAAATGATGGTTATGTCTTTAATCCAGCTGATATTATCGAAGATACGGGTAATGCTTATA
TCGTTCCTCATGGAGGTCACTATCACTACATTCCCAAAAGCGATTTATCTGCTAGTGAATTAGCAGCAGCTAAAGC
ACATCTGGCTGGAAAAAATATGCAACCGAGTCAGTTAAGCTATTCTTCAACAGCTAGTGACAATAACACGCAATC
TGTAGCAAAAGGATCAACTAGCAAGCCAGCAAATAAATCTGAAAATCTCCAGAGTCTTTTGAAGGAACTCTATGA
TTCACCTAGCGCCCAACGTTACAGTGAATCAGATGGCCTGGTCTTTGACCCTGCTAAGATTATCAGTCGTACACCA
AATGGAGTTGCGATTCCGCATGGCGACCATTACCACTTTATTCCTTACAGCAAGCTTTCTGCCTTAGAAGAAAAGA
TTGCCAGAATGGTGCCTATCAGTGGAACTGGTTCTACAGTTTCTACAAATGCAAAACCTAATGAAGTAGTGTCTAG
TCTAGGCAGTCTTTCAAGCAATCCTTCTTCTTTAACGACAAGTAAGGAGCTCTCTTCAGCATCTGATGGTTATATTT
TTAATCCAAAAGATATCGTTGAAGAAACGGCTACAGCCTTATATTGTAAGACATGGTGATCATTTCCATTACATTCC
AAAATCAAATCAAATTGGGCAACCGACTCTTCCAAACAATAGTCTAGCAACACCTTCTCCATCTCTTCCAATCAAT
CCAGGAACTTCACATGAGAAACATGAAGAAGATGGATACGGATTTGATGCTAATCGTATTATCGCTGAAGATGAA
TCAGGTTTTGTCATGAGTCACGGAGACCACAATCATTATTTCTTCAAGAAGGACTTGACAGAAGAGCAAATTAAG
GTGCGCAAAAACATTTAG 4139.1                                                          (SEQ. ID. NO. 247)
ATGAAAAAAAGAGCAATAGTGGCAGTCATTGTACTGCTTTTGATTGGGCTGGATCAGTTGGTCAAATCCTATATCG
TCCAGCAGATTCCACTGGGTGAAGTGCGCTCCTGGATCCCCAATTTCGTTAGCTTGACCTACCTGCAAATCGAGG
TGCAGCCTTTTCTATCTTACAAGATCAGCAGCTGTTATTCGCTGTCATTACTCTGGTTGTCGTGATAGGTGCCATTT
GGTATTTACATAAAACACATGGAGGACTCATTCTGGATGGTCTTGGGTTTGACTCTAATAATCGCGGGTGGTCTTGG
AAACTTTATTGACAGGGTCAGTCAGGGCTTTGTTGTGGATATGTTCCACCTTGACTTTATCAACTTTGCAATTTTCA
ATGTGGCAGATAGCTATCTGACGGTTGGAGTGATTATTTTATTGATTGCAATGCTAAAAGAGGAAATAAATGGAA
ATTAA 4139.5                                                          (SEQ. ID. NO. 248)
ATGAATACAAATCTTGCAAGTTTTATCGTTGGACTGATCATCGATGAAAACGACCGTTTTTACTTTGTGCAAAAGG
ATGGTCAAACCTATGCTCTTGCTAAGGAAGAAGGCCAACATACAGTAGGGGATACGGTCAAAGGTTTTGCATACA
CGGATATGAAGCAAAAACTCCGCCTGACAACCTTAGAAGTGACTGCCACTCAGGACCAATTTGGTTGGGGACGTG
TCACAGAGGTTCGTAAGGACTTGGGTGTCTTTGTGGATACAGGCCTTTCCTGACAAGGAAATCGTTGTGTCACTCGA
TATTCTCCCTGAGCTCAAGGAACTCTGGCCTAAGAAGGGCGACCAACTCTACATCCGTCTTGAAGTGGATAAGAA
AGACCGTATCTGGGGCCTCTTGGCTTATCAAGAAGACTTCCAACGTCTTGCTCGTCCTGCCTACAACAACATGCAG
AACCAAAACTGGCCAGCCATTGTTTACCGTCTCAAGCTGTCAGGAACTTTTGTTTACCTACCAGAAAATAATATGC
TTGGTTTTATTCATCCTAGCGAGCGTTACGCAGAGCCACGTTTGGGGCAAGTATTAGATGCGCGCGTTATTGGTTT
CCGTAAGTGGACCGCACTCTGAACCTCTCCCTCAAACCACGCTCCTTTGAAATGTTGGAAAACGATGCTCAGATG
ATTTTGACTTATTTGGAAAGCAATGGCGGTTTCATGACCCTTAAATGACAAGTCATCTCCAGACGACATCAAGGCAA

TABLE 1-continued

CCTTTGGCATTTCTAAAGGTCAGTTCAAGAAAGCTTTAGGTGGTCTTATGAAGGCTGGTAAAATCAAGCAGGACCA
GTTTGGGACAGAGTTGATTTAG 4139.8 (SEQ. ID. NO. 249)
ATGAAAGATGTTAGTCTATTTTTATTGAAAAAAGTTTTCAAAAGCCGCTTAAACTGGATTGTCTTAGCTTTATTTGT
ATCTGTACTCGGTGTTACCTTTTATTTAAATAGTCAGACTGCAAACTCACACAGCTTGGAGAGCAGGTTGGAAAGT
CGCATTGCAGCCAACGAGAGGGCTATCAATGAAAATGAAGAGAAACTCTCCCAAATGTCTGATACCAGCTCGGAG
GAATACCAGTTTGCTAAAAATAATTTAGACGTGCAAAAAAATCTTTTGACGCGAAAGACAGAAATTCTGACTTTAT
TAAAAGAAGGGCGCTGGAAAGAAGCCTACTATTTGCAGTGGCAAGATGAAGAGAAGAATTATGAATTTGTATCAA
ATGACCCGACTGCTAGCCCTGGCTTAAAAATGGGGGTTGACCGCGAACGGAAGATTTACCAAGCCCTGTATCCCT
TGAACATAAAAGCACATACTTTGGAGTTTCCGACCCACGGGATTGATCAGATTGTCTGGATTTTAGAGGTTATCAT
CCCAAGTTTGTTTGTGGTTGCTATTATTTTTATGCTAACACAACTATTTGCAGAAAGATATCAAAATCATCTGGAC
ACAGCTCACTTATATCCTGTTTCAAAAGTGACATTTGCAATATCCTCTCTTGGAGTTGGAGTGGGATATGTAACTG
TGCTGTTTATCGGAATCTGTGGCTTTTCTTTTCTAGTGGGAAGTCTGATAAGTGGTTTTGGACAGTTAGATTATCCC
TACCCAATTTATAGCTTAGTGAATCAAGAAGTAACTATTGGGAAAATACAAGATGTATTATTTCCTGGCTTGCTCT
TAGCTTTCTTAGCCTTTATCGTCATTGTGGAAGTTGTGTACTTGATTGCTTACTTTTTCAAGCAAAAAATGCCTGTC
CTCTTTCTTTCACTCATTGGGATTGTTGGCTTATTGTTTGGTATCCAAACCATTCAGCCTCTTCAAAGGATTGCACA
TCTGATTCCCTTTACTTACTTGCGTTCAGTGGAGATTTTATCTGGAAGATTACCTAAGCAGATTGATAATGTCGATC
TAAATTGGAGCATGGGAATGGTCTTACTTCCTTGCCTGATTATCTTTTTGCTATTGGGAATTCTATTTATTGAAAGA
TGGGGAAGTTCACAGAAAAAGAATTTTTTAATAGATTCTAG 4141.1 (SEQ. ID. NO. 250)
ATGATGAAGTTCATATTGGATATTGTTAGTACACCAGCTATTTTAGTAGCTTTAATTGCAATCTTAGGATTAGTTCT
TCAGAAGAAGAAATTACCTGATATTATTAAAGGTGGAATTAAGACCTTTGTTGGTTTCTTAGTTGTATCTGGTGGT
GCAGGAATTGTACAAAATTCTTTAAATCCATTTGGTACCATGTTTGAGCATGTCTTTTCATTTATCTGGCGTTGTGCC
GAATAATGAAGCAATTGTAGCTGTAGCTTTAACAACATATGGCTCAGCTACTGCAATGATTATGTTTGCAGGCATG
GTGTTCAATATCTTAATCGCTCGTTTTACTCGATTTAAATATATTTTTTTAACAGGGCACCACACTCTATATATGGC
ATGTATGATTGCGGTCATTTTATCAGTTGCTGGCTTTACTAGCTTGCCTCTCATCTTACTAGGAGGATTAGCACTCG
GTATTATTATGAGTATTTCCCCAGCATTTGTGCAAAAATATATGGTTCAATTAACTGGAAATGACAAGGTAGCTTT
AGGTCATTTCAGTTCTTTGGGATATTGGTTGAGTGGTTTTACTGGTAGCCTTATCGGTGACAAATCAAAATCAACA
GAGGACATTAAATTTCCAAAGAGTTTAGCTTTTTTACGTGATAGTACTGTTAGTATTACTTTATCCATGGCAGTTAT
TTACATTATTGTAGCTATCTTTGCAGGGTCAGAATATATAGAAAAGAAATCAGTAGTGGTACAAGTGGTCTAGTT
TATGCTTTACAATTAGCAGGTCAATTTGCAGCAGGGGTATTTGTTATTTTAGCAGGTGTTCGCCTTATTTTGGGCGA
AATTGTTCCAGCCTTTAAAGGTATTTCAGAGCGTCTTGTACCTAATTCAAAACCTGCTTTGGATTGTCCGATTGTTT
ATACTTATGCACCCAATGCAGTTCAATTGGATTTATCTCTAGTTTTTGTTGGTGGTTTAGTAAGTATGGTAATTATG
ATTGCTTCAGGAACGGTTGTTATCTTACCAGGTGTTGTGCCTCATTTCTTCTGTGGAGCGACTGCAGGTGTCATTGG
GAATGCATCTGGTGGTGTTCGTGGAGCCACTATTGGAGCATTTTTACAAGGTATTTTAATCAGTTTTCTTCCAGTCT
TTTTAATGCCAGTTTTGGGAGGACTTGGTTTCCAAGGATCAACTTTCTCAGATGCAGATTTTGGTCTATCAGGAATT
ATTTTAGGAATGTTAAATCAATTTGGCTCACAAGCAGGCATTGTGATTGGTCTTGTTCTTATTCTAGCAGTTATGTT
TGGAGTATCCTTTATTAAAAAGCCATCTGCAACGGAGGAATAA 4142.3 (SEQ. ID. NO. 251)
ATGATTAAAACATTTCTCTCTGCCCTTTCGGTCATTCTCTTTTCTATCCCTATCATAACTTATTCTTTTTTCCCATCT
TCTAATCTTAACATTTGGCTATCTACCCAACCTATCTTGGCACAGATTTATGCCTTCCCCTTAGCTACTGCAACTAT
GGCTGCTATTTTAAGTTTCTTATTTTTTTTCCTATCTTTTTACAAGAAAAATAAACAAATACGGTTTTACTCTGCA
TTTTGCTCTTACTATCGCTCATATTACTATTATTCGGAACAGATAAAACCCTTTCTTCTGCATCAAATAAGACTAAA
AACTTAAAATTAGTAACTTGGAACGTCGCTAATCAAATAGAAGCACAACATATTGAGCGAATTTTTAGCCATTTTG
ACGCCGATATGGCTATATTCCCTGAACTAGCTACCAATATCAGAGGTGAGCAAGAAAACCAGAGAATCAAACTAT
TGTTTCATCAAGTTGGACTTTCTATGGCCAACTATGATATTTTCACTTCTCCACCTACCAATAGTGGAATAGCTCCT
GTGACTGTGATTGTCAAGAAAAGTTATGGTTTCTATACAGAAGCTAAAACTTTTTCATACAACACGGTTCGGGACAA
TTGTATTACATTCGAGAAAACAAAATATACCAGATATCATTGCCTTGCATACTGCGCCTCCTCTGCCAGGTTTAAT
GGAAATCTGGAAGCAAGACTTAAACATCATTCATAATCAATTGGCTTCAAAATATCCAAAGGCTATTATTGCAGGT
GATTTTAATGCAACTATGCGTCATGGAGCACTTGCAAAAATAAGCTCTCATAGGGACGCATTAAATGCACTGCCA
CCTTTTGAAAGAGGAACTTGGAATAGCCAAAGTCCAAAACTTTTTAATGCAACAATAGATCATATTTTATTGCCTA
AAAACCACTACTATGTTAAAGATTTAGACATTGTAAGTTTTCAAAAACTCTGATCATAGATGTATTTTTACAGAAAT
CACATTTTAA 4142.4 (SEQ. ID. NO. 252)
ATGAATCCAATCCAAAGATCTTGGGCTTATGTCAGCAGAAAGCGACTGAGAAGTTTTATTTTATTTCTGATTTTAT
TGGTCTTATTGGCCGGAATTTCAGCCTGTTTGACTCTGATGAAGTCCAACAAAACAGTAGAAAGCAATCTTTATAA
ATCACTCAATACATCTTTTTCTATTAAGAAGATAGAGAATGGTCAGACATTCAAGTTGTCAGACCTAGCATCTGTA
AGCAAGATTAAGGGGCTGGAAAATGTCTCTCCTGAACTTGAGACGGTCGCAAAACTAAAAGACAAGGAAGCAGTG
ACTGGCGAGCAGAGCGTGGAGCGTGATGATTTATCAGCTGCAGACAATAACTTGGTTAGCTTAACGGCTCTTGAG
GATTCATCCAAGGATGTAACCTTTACCAGTTCGGCTTTCAATCTAAAAGAAGGGCGACACCTTCAAAAAGGGGAT
TCCAAGAAAATCCTTATCCACGAAGAATTGGCTAAGAAGAACGGTCTTTCGCTTCATGACAAGATTGGCTTGGATG
CTGGTCAGTCTGAATCTGGAAAAGGACAAACAGTAGAGTTTGAGATTATCGGCATCTTTTCTGGTAAAAAACAAG
AGAAATTCACAGGCTTGTCTTCTGACTTCAGTGAAAATCAAGTCTTTACAGACTATGAAAGTAGCCAAACCCTTTT
GGGCAATAGTGAAGCTCAAGTCAGTGCAGCACGCTTCTATGTAGAAAATCCTAAGGAAATGGACGGACTCATGAA
GCAGGTAGAAAACTTGGCCTTGGAAAATCAAGGCTACCAAGTCGAAAAGGAAACAAGGCTTTTGAACAAATCAA
AGACTCAGTTGCAACTTTCCAAACCTTCCTGACCATCTTCCTTTATGGGATGTTGATAGCAGGAGCTGGAGCCTTA
ATTCTGGTTTTGTCTCTCTGGTTGAGAACGGGTCTATGAAGTGGGGATTTTACTTGCACTTGGAAAAGGCAAGA
GCTCGATCTTCCTACAATTCTGTTTAGAGGTAGTTTTGGTATCTCTTGGAGCTTTGCTTCCAGCATTTGTTGCAGGA
AACGCAATCACAACTTACCTACTCCAAACTCTACTAGCAAGTGGAGATCAGGCAAGCTTACAAGATACACTAGCC
AAAGCAAGCAGTTTATCAACTAGCATCTTATCTTTTGCAGAATCCTATGTTTTCTAGTTCTGCTTAGTTGCTTATC
TGTAGCCCTTTGTTTCCTATTCTTATTTAGAAAATCACCGAAAGAAATTTTATCATCTATTAGTTAA 4142.5 (SEQ. ID. NO. 253)
ATGTTACACAACGCATTTGCCTATGTTACAAGGAAGTTTTTCAAATCGATTGTCATCTTCCTGATTATTCTCCTCAT
GGCGAGCTTGAGTTTGGTCGGCTTGTCAATCAAGGGAGCTACTGCCAAGGCTTCTCAGGAGACCTTTAAAAATATC

TABLE 1-continued

ACCAATAGCTTCTCCATGCAAATCAATCGTCGCGTCAACCAAGGAACGCCTCGTGGTGCTGGGAATATCAAGGGT
GAAGACATCAAAAAAATCACCGAAAACAAGGCCATTGAGTCTTATGTCAAACGTATCAACGCTATCGGAGATTTG
ACTGGATATGACCTGATTGAAACGCCAGAAACCAAGAAGAATCTCACTGCTGATCGTGCCAAGCGTTTTGGAAGT
AGCTTGATGATTACAGGTGTCAATGACTCCTCTAAAGAAGACAAGTTTGTCTCTGGTTCTTATAAACTAGTCGAAG
GAGAGCACTTAACCAACGACGACAAGGATAAAATCCTCTTGCACAAGGACTTGGCAGCCAAACACGGCTGGAAA
GTAGGGGACAAGGTTAAACTGGACTCTAATATCTACGATGCAGATAATGAAAAAGGAGCCAAGGAAACAGTTGA
AGTGACAATCAAGGGACTCTTTGATGGTCATAATAAGTCAGCAGTAACCTACTCACAAGAACTTTACGAAAACAC
AGCTATTACAGACATTCACACTGCTGCAAAACTTTATGGATACACAGAAGACACAGCCATTTATGGGGACGCAAC
CTTCTTTGTAACAGCAGACAAGAACTTGGATGATGTTATGAAAGAGTTGAATGGCATCAGTGGTATCAACTGGAA
GAGCTACACACTCGTCAAGAGCTCCTCTAACTACCCAGCTCTTGAGCAATCTATCTCTGGTATGTACAAGATGGCC
AACCTCCTCTTCTGGGGTAGCTTGAGCTTCTCAGTTCTCCTCCTTGCCCTCTTGCTCAGCCTTTGGATCAACGCCCG
TCGCAAGGAAGTGGGAATTCTCCTCTCTATCGGCCTCAAGCAGGCAAGTATCTTGGGTCA
ATTCATCACCGAATCTATCTTGATTGCTATCCCTGCTCTAGTTTCTGCTTACTTCCTAGCTAATTACACTGCCCGTG
CAATTGGAAACACTGTCCTTGCCAATGTGACTTCAGGTGTTGCCAAACAGGCTAGTAAGGCGGCTCAAGCCTCTA
ACCTTGGTGGTGGTGCAGAAGTAGATGGCTTTAGCAAGACCTTGTCGAGCCTAGACATTTCCATTCAGACATCAGA
CTTTATCATCATTTTTGTCCTTGCCTTGGTTCTAGTGGTTCTCGTTATGGCGCTTGCTTCAAGCAATCTCCTTAGAA
AACAACCAAAAGAGCTCTTGCTGGATGGTGAATAA 4144.1                                                                (SEQ. ID. NO. 254)
ATGTCACAGGATAAACAAATGAAAGCTGTTTCTCCCCTTCTGCAGCGAGTTATCAATATCTCATCGATTGTCGGTG
GGGTTGGGAGTTTGATTTTCTGTATTTGGGCTTATCAGGCTGGGATTTTACAATCCAAGGAAACCCTCTCTGCCTTT
ATCCAGCAGGCAGGCATCTGGGGTCCACCTCTCTTTATCTTTTTACAGATTTTACAGACTGTCGTCCCTATCATTCC
AGGGGCCTTGACCTCGGTGGCTGGGGTCTTTATCTACGGGCACATCATCGGGACTATCTACAACTATATCGGCATC
GTGATTGGCTGTGCCATTATCTTTTATCTAGTGCGCCTATACGGACGTGCCTTTGTCCAGTCTGTCGTCGCAGCAAGC
GCACCTACGACAAGTACATCGACTGGCTAGATAAGGGCAATCGTTTTGACCGCTTCTTTATTTTTATGATGATTTG
GCCCATTAGCCCAGCTGACTTTCTCTGTATGCTGGCTGCCCTGACCAAGATGAGCTTCAAGCGCTACATGACCATC
ATCATTCTGACCAAACCCTTTACCCTCGTGGTTTATACCTACGGTCTGACCTATATTATTGACTTTTTCTGGCAAAT
GCTTTGA 4144.2                                                                (SEQ. ID. NO. 255)
ATGAGAAATATGTGGGTTGTAATCAAGGAAACCTATCTTCGACATGTCGAGTCATGGAGTTTCTTCTTTATGGTGA
TTTCGCCGTTCCTCTTTTTAGGAATCTCTGTAGGAATTGGGCATCTCCAAGGTTCTTCTATGGCTAAAAATAATAAA
GTGGCAGTAGTGACAACAGTGCCATCTGTAGCAGAAGGACTGAAGAATGTAAATGGTGTTAACTTCGACTATAAA
GACGAAGCAAGTGCCAAAGAAGCAATTAAAGAAGAAAAATTAAAAGGTTATTTGACCATTGATCAAGAAGATAGT
GTTCTAAAGGCAGTTTATCATGGCGAAACATCGCTTGAAAATGGAATTAAATTTGAGGTTACAGGTACACTCAATG
AACTGCAAAATCAGCTTAATCGTTCAACTGCTTCCTTGTCTCAAGAGCAGGAAAAACGCTTAGCGCAGACAATTC
AATTCACAGAAAAGATTGATGAAGCCAAGGAAAATAAAAAGTTTATTCAAACAATTGCAGCAGGTGCCTTAGGAT
TCTTTCTTTATATGATTCTGATTACCTATGCGGGTGTAACAGCTCAGGAAGTTGCCAGTGAAAAAGGCACCAAAAT
TATGGAAGTCGTTTTTTCTAGCATAAGGGCAAGTCACTATTTCTATGCGCGGATGATGGCTCTGTTTCTAGTGATTT
TAACGCATATTGGGATCTATGTTGTAGGTGGTCTGGCTGCCGTTTTGCTCTTTAAAGATTTGCCATTCTTGGCTCAG
TCTGGTATTTTGCATCACTTGGGAGATGCTATCTCACTGAATACCTTGCTCTTTATTTTGATCAGTCTTTTCATGTA
CGTAGTCTTGGCAGCCTTCCTAGGATCTATGGTTTCTCGTCCTGAGGACTCAGGGAAAGCCTTGTCGCCTTTGATG
ATTTTGATTATGGTGGTTTTTTTGGAGTGACAGCTCTAGGTGCAGCTGGTGACAATCTCCTCTTGAAGATTGGTTC
TTATATTCCCTTTATTTCGACCTTCTTTATGCCGTTTCGAACGATTAATGACTATGCGGGGGGAGCAGAAGCATGG
ATTTCACTTGCTATTACAGTGATTTTTGCGGTGGTAGCAACAGGATTTATCGGACGCATGTATGCTAGTCTCGTTCT
TCAAACGGATGATTTAGGGATTTGGAAAACCTTTAAACGTGCCTTATCTTATAAATAG 4144.3                                                                (SEQ. ID. NO. 256)
ATGACAGAAACCATTAAATTGATGAAGGCTCATACTTCAGTGCGCAGGTTTAAAGAGCAAGAAATTCCCCAAGTA
GACTTAAATGAGATTTTGACAGCAGCCCAGATGGCATCATCTTGGAAGAATTTCCAATCCTACTCTGTGATTGTGG
TACGAAGTCAAGAGAAGAAAGATGCCTTGTATGAATTGGTACCTCAAGAAGCCATTCGCCAGTCTGCTGTTTTCCT
TCTCTTTGTCGGAGATTTGAACCGAGCAGAAAGGGAGCCCGACTTCATACCGACACCTTCCAACCCCAAGGTGT
GGAAGGTCTCTTGATTAGTTCGGTCGATGCAGCTCTTGCTGGACAAAACGCCTTGTTGGCAGCTGAAAGCTTGGGC
TATGGTGGTGTGATTATCGGTTTGGTTCGATACAAGTCTGAAGAAGTGGCAGAGCTCTTTAACCTACCTGACTACA
CCTATTCTGTCTTTGGGATGGCACTGGGTGTGCCAAATCAACATCGATATGAAACCGAGACTGCCACTAGAGA
ATGTTGTCTTTGAGGAAGAATACCAAGAACAGTCAACTGAGGCAATCCAAGCTTATGACCGTGTTCAGGCTGACT
ATGCTGGGCGCGTGCGACCACAAGCTGGAGTCAGCGCCTAGCAGAACAGTTTGGTCAAGCTGAACCAAGCTCAA
CTAGAAAAAATCTTGAACAGAAGAAATTATTGTAG 4146.1                                                                (SEQ. ID. NO. 257)
ATGTTAAAACTTATTGCTATTGTTGGAACAAATTCAAAACGTTCTACAAACCGTCAATTGCTTCAATACATGCAAA
AACACTTTACTGACAAAGCTGAAATTGAACTTGTTGAAATCAAGGCCATTCCTGCTCTTCAACAAACCAGCTGACAA
GCAAGTACCTGCTGAAATATTGGAAATTGCTGCTAAAATCGAAGAGGCAGATGGCGTTATTATCGGTACTCCTGA
GTATGATCACTCTATTCCAGCTGTTTTGATGAGCGCTCTTGCTTGGTTGTCTTATGGTATTTACCCACTTTTGAACA
AACCAATCATGATTACAGGTGCTTCTTACGGTACGCTTGGTTCATCTCGTGCCCAATTGCAACTTCGTCAAATCTT
GAATGCTCCTGAAATCAAGGCAAATGTTCTTCCAGATGAATTCTTGCTCTACAACACTCTTCAAGCATTTAACCCA
AGTGGCGACTTGGTTGACCTTGATGTTATCAAGAAATTGGATGCCATCTTTGATGACTTCCGTATCTTTGTAAAAA
TCACAGAAAAATTACGTAATGCACAAGAATTACTTCGCAAAGATGCTGAAGACTTTGACTGGGAAAATTTGTAA 4146.2                                                                (SEQ. ID. NO. 258)
ATGAATACCTATCAATTAAATAATGGAGTAGAAATTCCAGTATTGGGATTTGGAACTTTTAAGGCTAAGGATGGA
GAAGAAGCCTATCGTGCAGTGTTAGAAGCCTTGAAGGCTGGTTATCGTCATATTGATACGGCGGCGATTTATCAGA
ATGAAGAAAGTGTTGGTCAAGCAATCAAAGATAGCGGAGTTCCACGTGAAGAAATGTTCGTAACTACCAAGCTTT
GGAATAGTCAGCAAACCTATGAGCAAACTCGTCAAGCTTTGGAAAAATCTATAGAAAAACTGGGCTTGGATTATT
TGGATTTGTATTTGATTCATTGGCCGAACCCAAAACCGCTCAGAGAAAATGACGCATGGAAAACTCGCAATGCGG
AAGTTTGGAGAGCGATGGAAGACCTCTATCAAGAAGGGAAATCCGTGCTATCGGCGTTAGCAATTTTCTTCCCC
ATCATTTGGATGCCTTGCTTGAAACTGCAACTATCGTTCCTGCGGTCAATCAAGTTCGCTTGGCGCCAGGTGTGTA
TCAAGATCAAGTCGTAGCTTACTGTCGTGAAAAGGGAATTTTATTGGAAGCTTGGGGGCCTTTTGGACAAGGAGA
ACTGTTTGATAGCAAGCAAGTCCAAGAAATAGCAGCAAATCACGGAAAATCGGTTGCTCAGATAGCCTTGGCCTG

TABLE 1-continued

GAGCTTGGCAGAAGGATTTTTACCACTTCCAAAATCTGTCACAACCTCTCGTATTCAAGCTAATCTTGATTGCTTT
GGAATTGAACTGAGTCATGAGGAGAGAGAAACCTTAAAAACGATTGCTGTTCAATCGGGTGCTCCACGAGTTGAT
GATGTGGATTTCTAG 4147.1 (SEQ. ID. NO. 259)
ATGAGGTGCAAAATGCTTGATCCAATTGCTATTCAACTAGGACCCCTAGCCATTCGTTGGTATGCCTTATGTATTG
TGACAGGCTTGATTCTTGCGGTTTATTTGACCATGAAAGAAGCACCTAGAAAGAAGATCATACCAGACGATATTTT
AGATTTTATCTTAGTAGCCTTTCCCTTGGCTATTTTAGGAGCTCGTCTCTACTATGTTATTTTCCGATTTGATTACTA
TAGTCAGAATTTAGGAGAGATTTTTGCCATTTGGAATGGTGGTTTGGCCATTTACGGTGGTTTGATAACTGGGGCT
CTTGTGCTCTATATCTTTGCTGACCGTAAACTCATCAATACTTGGGATTTTCTAGATATTGCGGCGCCTAGCGTTAT
GATTGCTCAAAGTTTGGGGCGTTGGGGTAATTTCTTTAACCAAGAAGCTTATGGTGCAACAGTGGATAATCTGGAT
TATCTACCTGGCTTTATCCGTGACCAGATGTATATTGAGGGGAGCTACCGTCAACCGACTTTCCTTTATGAGTCTC
TATGGAATCTGCTTGGCTTTGCCTTGATTCTGATTTTTAGACGGAAATGGAAGAGTCTCAGACGAGGTCATATCAC
GGCCTTTTACTTGATTTGCTATGGTTTCGGTCGTATGGTTATCGAAGGTATGCGAACAGATAGTCTCATGTTCTTCG
GCTTTCGAGTGTCCCAATGGCTGTCAGTTGTCCTTATCGGTCTCGGTATAATGATCGTTATTTATCAAAATCGAAA
GAAGGCCCCTTACTATATTACAGAGGAGGAAAACTAA 4147.2 (SEQ. ID. NO. 260)
ATGGGTAAATTATCCTCAATCCTTTTAGGAACCGTTTCAGGTGCAGCTCTTGCCTTGTTTTTAACAAGTGATAAGG
GCAAACAAGTTTGCAGTCAGGCTCAAGATTTTCTAGATGATTTGAGAGAAGATCCGGAGTATGCCAAGGAGCAAG
TCTGTGAAAAACTGACAGAAGTTAAGGAGCAGGCTACAGATTTTGTTCTGAAAACAAAAGAACAGGTTGAGTCAG
GTGAAATCACTGTGGACAGTATACTTGCTCAAACTAAATCCTATGCTTTTCAAGCGACAGAAGCATCAAAAAATC
AATTAAATAATCTCAAGGAGCAATGGCAAGAAAAAGCCGAAGCTCTTGATGACTCAGAAGAGATTGTGATTGATA
TAACAGAAGAATAA 4147.3 (SEQ. ID. NO. 261)
ATGAAAACTAAATTGATCTTTTGGGGCTCTATGCTCTTTCTCCTCTCCCTCTCCATCCTTCTGACCATTTATCTGGC
TTGATTTTCTATCCTATGGAGATTCAGTGGCTAAACTTAACGAATCGAGTCTATCTAAAACCAGAAACCATTCAA
TACAATTTTCATATCTTGATGAATTATCTGACCAATCCTTTTAGTCAGGTCTTACAGATGCCTGATTTTCGTTCGTC
AGCAGCTGGTCTGCACCATTTCGCAGTGGTCAAGAATCTCTTTCATTTGGTTCAGCTAGTAGCTCTAGTGACACTG
CCAAGTTTCTATGTCTTTGTCAATAGGATTGTGAAAAAGGACTTTTTGTCTCTTTATCGAAAAGTCTCCTGGCTCT
AGTAGTCTTACCTGTGATGATTGGACTTGGGGGAGTTTTCATTGGTTTTGACCAATTCTTTACTCTTTTCCATCAAA
TTCTCTTTGTGGGAGATGATACCTGGCTTTTTGATCCAGCCAAGGATCCTGTTATTATGATTTTGCCAGAGACCTTC
TTTCTTCATGCCTTCCTCCTCTTTTTTGCCCTCTATGAAAACTTCTTTGGCTATCTGTATCTGAAAAGTCGTAGGAA
GTGA 4149.1 (SEQ. ID. NO. 262)
ATGACTTATCATTTTACTGAAGAATACGATATTATTGTAATTGGTGCGGGACACGCTGGGGTTGAGGCTTCCTTGG
CCGCTAGCCGTATGGGCTGTAAGGTCCTGCTTGCGACCATCAATATTGAAATGCTGGCTTTCATGCCTTGTAATCC
CTCTATCGGTGGTTCTGCCAAGGGGATTGTCGTGCGTGAAGTCGATGCCCTCGGTGGCGAGATGGCCAAAACCATT
GACAAGACTTACATCCAGATGAAGATGCTAAACACAGGGAAGGGGCAGCTCACCAAGTCCCAGGCCTCGTGCGCAGGCT
GACAAGGAACTTTACTCTAAGGAGATGCGCAAGACGGTTGAAAACCAAGAAAATCTGACCCCTTCGTCAAACCATG
ATTGATGAGATTTTGGTGGAAGATGGCAAGGTTGTCGGTGTGCGTACAGCCACCCATCAAGAATATGCTGCTAAG
GCTGTTATTGTGACGACAGGGACTGCTCTCCGTGGGGAAATTATCATCGGAGACCTCAAGTACTCATCAGGTCCTA
ACCACAGCTTGGCTTCTATTAACCTAGCTGACAATCTCAAGGAACTGGGTCTCGAAATCGGTCGTTTCAAGACAGG
ACCCCTCCACGTGTCAAGGCTTCTTCTATCAATTACGATGTGACAGAAATTCAGCCAGGAGACGAAGTGCCTAAT
CATTTCTCATACACACTTCACGTGATGAGGATTATGTCAAGGACCAAGTACCATGCTGGTTGACCTATACCAATGGTA
CCAGTCATGAGATTATCCAAAACAACCTCCACCGTGCGCCTATGTTTACAGGTGTGGTCAAGGGAGTGGGGCCTC
GTTACTGTCCGTCGATTGAAGACAAGATTGTGCGCTTTGCGGACAAGGAACGTCACCAACTCTTCCTTGAGCCAGA
AGGGCGCATTACTGAGGAAGTCTATGTGCAAGGACTTTCAACCAGTCTGCCTGAGGATGTCCAGCGTGACTTGGT
GCATTCCATCAAAGGTTTGGAAAATGCAGAGATGATGCGGACAGGTTATGCTATTGA
GTATGATATGGTCTTGCCTCATCAGTTGCGTGCGACTTTGGAAACCAAGAAAATCTCAGGTCTCTTCACTGCTGGT
CAGACAAATGGAACATCAGGTTACGAAGAGGCAGCAGGCCAAGGGATTATCGCGGGTATCAATGCGGCTCTGAA
AATCCAAGGCAAGCCTGAATTGATTTTGAAGCGCAGTGATGGTTATATCGGGTGATGATCGACGACTTGGTGAC
CAAGGGAACCATTGAACCCTACCGTCTCTTGACCAGTCGTGCTGAATACCGTCTCATTCTTCGTCATGACAATGCT
GATATGCGCTTGACTGAGATGGGACGCGAGATTGCCTTGTGGACGATGAACGCTGGGCTCGTTTTGAAATCAAG
AAAAATCAATTTGATAATGAGATGAAGCGCCTAGACAGTATCAAACTCAAGCCAGTCAAGGAAACCAATGCCAAG
GTTGAGGAGATGGCCTTCAAACCCTTGACCGATGCAGTGACAGTGAAGAATTCCTTCGCCGTCCAGAAGTTTCTT
ACCAAGATGTGGTGGCCTTCATCGGACCAGCTGCAGAAGACTTGGATGACAAGATTATCGAATTGATTGAAACAG
AAATCAAGTATGAAGGCTATATTTCCAAAGCCATGGACCAGGTTGCCAAGATGAAACGCATGGAAGAAAACGCA
TTCCGGCCAATATCGACTGGGATGACATTGATTCTATCGCAACCGAAGCCCGTCAGAAGTTCAAACTCATCAATCC
AGAAACCATCGGCCAAGCCAGCCGTATTTCGGGAGTAAACCCAGCAGATATTTCTATTTTGATGGTGTATCTGGAA
GGTAAAAATCGTAGTATTTCTAAAACTCTTCAAAAATCAAATGA 4149.2 (SEQ. ID. NO. 263)
ATGAAAGTATTAGCTTTTGATACGTCCAGCAAGGCTCTTTCTCTGGCTATTTTAGAGGATAAGCAGGTTCTTGCCG
AGACGACGATTAATATTAAGAAAAATCACAGTATTACTCTTATGCCTGCCATCGATTTTTTGATGGCAAGTTTGGA
TTGGACACCCAAGGATTTGGACCGAATCGTGGTAGCTGAAGGGCCGGGTAGCTATACAGGCTTGCGAATTGCGT
AGCAACTGCTAAGACCTTAGCTCACACCCTGAACATCGAGTTGGTTGGTATGTCGAGTCTCTTGGCTCTGGTGCCC
CATCAACAAGAAGGTTTGTTTGTCCCCTTGATGGATGCGCGTCGCAATAATGTTTATGCAGGATTTTATGAAAATG
CCAAACCTGTCATGGCAGAAGCGCACCTATCTTTTGAAGAGGTGCTAGAAAAAGTCAAGGGTACTAGTCAGGTAA
CCTTTGTCGGAGAAGTTGGCCCCTTTGTTGAGCAGATTCAAAAACACTTGCCAAGGACTGATTACAAAGAAACATT
GCCCAATGCAGCTAATCTAGCTCTTTTGGCCTGGGACAAGGAAGCAGACTCCTTGCATGATTTTGTGCCGAATTAC
CTCAAACGAGTCGAGGCTGAGGAAAACTGGCTCAAGAACCATACCGAGTCTGGCGAGTCTTACATTAAACGCCTA
TGA 4149.3 (SEQ. ID. NO. 264)
ATGATAGAAATCAAGCGAATTCAACAACAGCCTGACCTAGCTCAAGCCATCTACGCTGTTATGGCAGCTGTTTACC
TAGTCAGTCCTTGGACTCTGGAGCAAATCCAAGCAGATCTGTCCCAAGACCAGACTTGGTATGCATTGGCTTATGA

TABLE 1-continued

TGGGGCAGAAGTGATTGGATTTCTAGCTGTGCAGGAGAATCTTTTTGAAGCAGAAGTCCTGCAAATCGCTGTCAA
AGGAGCTTATCAGGGTCAGGGGATTGCGTCagCCTTGTTTGCTCAATTGCCGACAGACAAGGAAATTTTCCTCGAA
GTCAGACAGTCAAATCAACGAGCGCAAGCATTTTACAAGAAAGAAAAGATGACAGTTATCGCTGAGCGAAAGGC
CTACTACCATGACCCAGTCGAGGACGCCATTATCATGAAGAGAGAAATAGATGAAGGATAG 4152.2 (SEQ. ID. NO. 265)
ATGACAAAACAAGTCTTATTAGTGGATGATGAAGAACACATTCTGAAATTGCTTGACTACCATTTAAGTAAGGAA
GGCTTTTCTACTCAATTGGTGACAAATGGACGGAAGGCCTTAGCTTTGGCAGAAACAGAACCCTTTGATTTTATCT
TGCTTGATATCATGTTACCACAATTAGATGGCATGGAAGTTTGTAAGCGGCTGAGAGCCAAAGGCGTCAAAACTC
CAATTATGATGGTTTCTGCGAAAAGTGATGAATTTGATAAGGTTTTGGCCTTGGAATTAGGGGCTGATGACTACCT
GACCAAGCCTTTTAGCCCTAGAGAATTGCTGGCGGCGTGCAAGGCTGTCCTCAGGCGAACTAAAGGAGAACAAGA
AGGAGATGATTCAGATAATATCGCTGACGATTCTTGGCTATTTGGGACCTTGAAAGTATACCCTGAGCGTCATGAA
GTCTACAAGGCGAATAAGTTACTGAGTTTGACCCCAAAAGAATTTGAAAGCGATAAAAATCCGTTTTTTGAAGTTT
TCAAAGTTTCGAAAGTAACCGCCCAATAA 4154.1 (SEQ. ID. NO. 266)
ATGACTACTTTTAAAGATGGATTTTTATGGGGTGGTGCTGTTGCTGCTCATCAACTTGAAGGTGGATGGCAAGAAG
GTGGCAAGGGAATTAGTGTTGCTGATGTTATGACTGCTGGTCGTCATGGAGTAGCTCGTGAAATACTTTGGGAGT
TTTAGAGGGTAAATATTATCCAAATCATGAGGCGATAGATTTTTATCACCGTTATAAAGAAGATATAGCACTTTTT
GCTGAAATGGGATTCAAGTGCTTCCGTACCTCTATTGCATGGACACGTATCTTTCCAAAAGGTGATGAGTTAGAGC
CGAATGAAGAAGGATTACAGTTTTATGATAATCTTTTTGATGAATGCTTAAAGAATGGTATTGAACCTGTCATCAC
TCTATCTCATTTTGAAATGCCTTATCACTTAGTGACCGAATATGGTGGTTGGAAAAATAGGAAATTGATTGATTTC
TTTGCTCGTTTTGCAGAAGTCGTATTTAAACGTTACAAAGATAAGGTTAAATATTGGATGACTTTCAATGAAATCA
ATAATCAAGCGAATTATCAGGAAGATTTTGCACCATTTACTAACTCAGGTATTGTATATGAGGAAGGTGATAATAG
AGAAGCAATTATGTATCAAGCAGCACATTACGAATTAGTTGCTTCTGCACGAGCTGTAAAAATTGGTCATGAGATT
AATCCAGATTTTCAAATAGGTTGTATGATTGCGATGTGTCCAATTTATCCAGTTACTTGCAATCCTAAGGATATCTT
AATGGCAATGAAAGCTATGCAGAAGCGTTATTATTTTGCTGATGTGCATGTTTTAGGTAAATATCCTGAGCATATT
TTCAAGTATTGGGAACGAAAAGGTATTTCAGTTGATTTTACTGCCCAGGATAAAGAAGATTTACTTGGTGGGACTG
TAGATTACATTGGTTTCAGTTACTATATGTCCTTTGCTATCGACTCTCATCGTGAAAATAATCCTTATTTTGATTAT
CTTGAAACAGAAGATTTAGTGAAAAATAATTATGTTAAGGCTTCTGAATGGGAGTGGCAAATTGATCCAGAAGGT
TTGCGTTATGCGTTAAATTGGTTTACAGACCACTATCACTTACCACTCTTTATTGTTGAAAATGGTTTTGGAGCTAT
AGATCAAGTTGCAGCAGATGGTATGGTACATGATGATTATAGAATTGAATATCTAGGTGCCCATATTCGTGAAATG
AAAAAGGCTGTAGTTGAAGATGGTGTTGATTTAATGGGTTATACTCCATGGGGATGTATTGATTTGGTTTCAGCTG
GTACCGGTGAAATGCGGAAACGTTATGGCTTTATTTATGTAGATAAAGATGATAATGGGAAGGGAAGTTATAATC
GTTCCCCGAAAAAATCTTTTGGCTGGTATAAGGAAGTTATTTCATCTAACGGTGAATCAGTAGAATAG 4154.2 (SEQ. ID. NO. 267)
ATGGATCAACAAAACGGGTTGTTTGGTTTTCTTGAAAAACCATGTTATGGGACCAATGGGCAAACTTGCTCAGTTTA
AAGTAGTACGTGCTATCACGGCTGCAGGTATGGCTGCTGTACCATTTACTATTGTAGGATCAATGTTTTTGGTATT
CAGTATTTTGCCACAAGCTTTCTCATTTTGGCCAATTGTGGCAGATATTTTCTCTGCTTCATTTGATAAATTCACAT
CACTTTACATGGTTGCAAACTATGCGACTATGGGTTCTCTATCTCTTTATTTCGTTCTATCACTTGCATATGAATTG
ACAAAAAATTTATGCAGAGGAAGAAGAACTCAATATGAATCCTCTTAATGGTGCCTTGCTTGCCTTGATGGCTTTTG
TCATGACAGTACCGCAAATCATTTTTGATGGTGGAATGATGAAGACTGTGACAAGTCTAAAAGAAGGTGCAGTAA
TTGCAGATGGATGGGCAATGGGAAATGTCGTCGCACGTTTTGGGACAACAGGGATTTTTACCGCAATCATTATGG
CAATTGTGACTGTTCTTATTTATCGTATGTGTGTTAAACATAATTGGGTTATTAAAATGCCTGAAGCTGTTCCAGAA
GGAGTTTCTCGTGGATTTACCGCTTTGGTTCCGGGATTTGTTGTTGCATTTGTTGTTATCTTTATCAACGGTCTTCTT
GTAGCAATGGGAACAGATATTTTTAAAGTCATTGCAATTCCATTTGGTTTTGTATCCAATCTGACTAATTCGTGGA
TTGGTTTAATGATTATTTATCTATTGACTCAACTACTTTGGATTGTAGGTATCCACGGTGCGAACATTGTTTTTGCA
TTTGTTAGTCCAATTGCTCTTGCTAACATGGCTGAAAATGCTTGCTGGCGGGCACTTCGCTGTTGCAGGTGAATTTT
CTAATATGTTTGTAATTGCAGGTGGTTCTGGTGCAACTTTAGGACTATGTTTATATATTGCTTTTGCCTCTAAATCT
GAACAGCTTAAAGCAATAGGACGAGCATCTGTAGTTCCAGCCTTATTTAATATTAATGAACCATTAATTTTTGGAT
TACCTATTATCTATAATCCAGCCTTGGCTATACCATTTATTTTAGCACCAATGGTTACTGCTACTATTTATTACGTA
GCGAATTCTCTAAACTTTATTAAGCCAATTATCGCACAGGTTCCATGGCCAACTCCAGTAGGGATTGGAGCTTTCT
TAGGGACAGCAGATCTTCGAGCTGTATTAGTTGCTCTAGTATGTGCATTTGCAGCATTCCTAGTCTATCTTCCATTC
ATCCGTGTATATGATCAAAAATTGGTGAAAGAAGAGCAAGGTATCTAA 4155.1 (SEQ. ID. NO. 268)
ATGAAAAAATTTTATGTAAGTCCAATTTTTCCTATTCTAGTAGGATTGATTGCGTTTGGAGTCTTATCCACTTTCAT
TATTTTTGTTAATAATAATCTGTTGACGGTTTTAATTTTGTTTCTTTTTGTAGGAGGCTATGTTTTTTTATTTAAGAA
ACTGAGAGTGCATTATACAAGGAGTGATGTAGAACAGATACAGTATGTAAACCACCAAGCGGAAGAAAGTTTGAC
AGCTCTATTGGAACAGATGCCTGTAGGTGTTATGAAATTGAATTTATCTTCTGGAGAGGTTGAGTGGTTTAATCCC
TATGCTGAATTGATTTTGACCAAGGAAGATGGTGATTTTGATTTGAAGCTGTTCAAACGATTATCAAGGCTTCAG
TAGGAAATCCGTCTACTTATGCCAAGCTTGGTGAGAAGCGTTATGCTGTTCATATGGATGCTTCTTCCGGTGTTTT
GTATTTTGTAGATGTATCCAGGGAACAAGCCATAACAGATGAATTGGTAACAAGTAGACCAGTGATTGGGATTGT
CTCTGTGGATAATTATGATGATTTGGAGGATGAAACTTCTGAGTCAGATATTAGTCAAATCAATAGTTTTGTAGCT
AATTTTATATCAGAGTTTTCAGAAAAACACATGATGTTTTCTCGTCGGGTAAGTATGCATCGTCGATTTTATCTATTTAC
TGACTACACGGTGCTTGAGGGCTTGATGAATGATAAATTTTCTGTTATTGATGCTTTCAGAGAAGAGTCGAACAG
AGACAGTTGCCCTTGACCTTAAGTATGGGATTTTCTTATGGCATGGAAATCATGATGAGATAGGGAAAGTTGCTT
TGCTCAATTTGAACTTGGCTGAAGTACGTGGTGGCGACCAGGTGGTTGTTAAGGAAAACGACGAAACGAAAAATC
CAGTTTATTTTGGTGGTGGGTCTGCTGCTTCAATCAAGCGTACACGGACTCGTACGCGCGCTGATGACAGCTAT
TTCAGATAAGATTCGGAGTGTAGATCAGGTTTTTGTAGTCGGTCACAAAAATTTAGACATGGATGCTTTGGGCTCT
GCTGTAGGTATGCAGTTGTTCGCCAGCAATGTGATTGAAAATAGCTATGCTCTTTATGATGAAGAACAAATGTCTC
CAGATATTGAACGAGCTGTTTCATTCATAGAAAAAGAAGGAGTTACGAAGTTGTTGTCTGTTAAGGATGCAATGG
GGATGGTGACCAATCGTTCTTTGTTGATTCTTGTAGACCATTCAAAGACAGCAGCCTTAACATTATCAAAAGAATTTTA
TGATTTATTTACCCAAACCATTGTTATTGACCACCATAGAAGGGATCAGGATTTTCCAGATAATGCGGTTATTACT
TATATCGAAAGTGGTGCAAGTAGTGCCAGTGAGTTGGTAACGGAATTGATTCAGTTCCAGAATTCTAAGAAAAAT
CGTTTGAGTCGTATGCAAGCAAGTGTCTTGATGGCTGGTATGATGTTGGATACTAAAAATTTCACCTCGCGAGTAA
CTAGTCGGACATTTGATGTTGCTAGCTATCTCAGAACGCGCGGAAGTGATAGTATTGCTATCCAGGAAATCGCTGC
GACAGATTTTGAAGAATATCGTGAGGTCAATGAACTTATTTTACAGGGGCGTAAATTAGGTTCAGATGTACTAATA

TABLE 1-continued

```
GCAGAGGCTAAGGACATGAAATGCTATGATACAGTTGTTATTAGTAAGGCAGCAGATGCCATGTTAGCCATGTCA
GGTATTGAAGCGAGTTTTGTTCTTGCAAGAATACACAAGGATTTATCTCTATCTCAGCTCGAAGTCGTAGTAAAC
TGAATGTACAACGGATTATGGAAGAGTTAGGCGGTGGAGGCCACTTTAATTTGGCAGCAGCTCAAATTAAAGATG
TAACCTTGTCAGAAGCAGGTGAAAAACTGACAGAAATTGTATTAAATGAAATGAAGGAAAAGGAGAAAGAAGAA
TGA
```

4156.1                                                                (SEQ. ID. NO. 269)
```
ATGAAAGAGAAAAATATGTGGAAAGAATTGTTGAATCGTGCAGGCTGGATTTTGGTCTTTTTACTTGCCGTCCTTT
TATATCAGGTTCCCCTAGTGGTTACCTCTATTTTGACTTTAAAAGAAGTAGCCCTGCTACAGTCAGGGCTGATAGT
TGCTGGCCTTTCAATTGTGGTTCTGGCTCTATTTATTATGGGAGCTCGTAAAACCAAGTTAGCTAGTTTTAATTTTT
CTTTTTTTAGAGCTAAAGATTTGGCACGTTTGGGCTTGAGTTATCTAGTTATTGTCGGGTCAAATATACTTGGTTCC
ATTTTATTGCAACTGTCAAATGAGACGACAACAGCTAACCAGTCTCAGATTAATGATATGGTTCAAAATAGTTCGT
TGATTTCCAGTTTCTTCTTGCTAGCCTTGCTTGCTCCGATTTGTGAGGAAATCTTGTGTCGTGGGATTGTTCCTAAA
AAGATTTTCCGAGGCAAGGAGAACTTGGGATTTGTAGTCGGTACGATTGTGTTTGCTTTATTGCATCAACCAAGTA
ATTTACCTTCTTTATTGATTTATGGAGGTATGTCGACAGTTCTATCTTGGACAGCCTACAAGACCCAACGTTTGGA
AATGTCGATCTTGCTTCACATGATTGTTAATGGGATTGCTTTCTGTTTGTTGGCTCTTGTGGTGATTATGAGTCGGA
CATTAGGAATTTCTGTTTAAATGAAAGAGAAAAATATGTGGAAAGAATTGTTGAATCGTGCAGGCTGGATTTTGGT
CTTTTTACTTGCCGTCCTTTTATATCAGGTTCCCCTAGTGGTTACCTCTATTTTGACTTTAAAAGAAGTAGCCCTGC
TACAGTCAGGGCTGATAGTTGCTGGCCTTTCAATTGTGGTTCTGGCTCTATTTATTATGGGAGCTCGTAAAACCAA
GTTAGCTAGTTTTAATTTTTCTTTTTTTAGAGCTAAAGATTTGGCACGTTTGGGCTTGAGTTATCTAGTTATTGTCG
GGTCAAATATACTTGGTTCCATTTTATTGCAACTGTCAAATGAGACGACAACAGCTAACCAGTCTCAGATTAATGA
TATGGTTCAAAATAGTTCGTTGATTTCCAGTTTCTTCTTGCTAGCCTTGCTTGCTCCGATTTGTGAGGAAATCTTGT
GTCGTGGGATTGTTCCTAAAAAGATTTTCCGAGGCAAGGAGAACTTGGGATTTGTAGTCGGTACGATTGTGTTTGC
TTTATTGCATCAACCAAGTAATTTACCTTCTTTATTGATTTATGGAGGTATGTCGACAGTTCTATCTTGGACAGCCT
ACAAGACCCAACGTTTGGAAATGTCGATCTTGCTTCACATGATTGTTAATGGGATTGCTTTCTGTTTGTTGGCTCTT
GTGGTGATTATGAGTCGGACATTAGGAATTTCTGTTTAA
```

4156.4                                                                (SEQ. ID. NO. 270)
```
ATGGATACACAAAAGATTGAAGCGGCTGTAAAAATGATTATCGAGGCTGTAGGAGAGGACGCTAATCGCGAGGGC
TTGCAGGAAACACCTGCTCGTGTAGCCCGTATGTATCAAGAGATTTTTTCAGGTCTTGGTCAAACAGCAGAGGAAC
ATTTGTCAAAATCCTTTGAAATTATTGACGATAATATGGTGGTAGAAAAGGATATCTTTTTCCATACCATGTGTGA
ACACCACTTCTTGCCATTTTATGGTAGAGCGCACATTGCCTACATTCCAGATGGTCGTGTGGCAGGCTTGTCTAAG
CTAGCCCGTACGGTTGAAGTTTATTCGAAAAAACCACAAATTCAAGAACGTTTGAATATCGAAGTGGCCGATGCC
TTGATGGACTATCTAGGTGCTAAAGGAGCCTTTGTTGTCATTGAGGCGGAACATATGTGTATGAGTATGCGTGGTG
TTAGAAAACCAGGCACTGCAACCTTGACGACAGTAGCTCGTGGTCTATTTGAAACAGATAAGGATCTCCGTGACC
AAGCTTATCGTTTAATGGGCTATAA
```

4157.2                                                                (SEQ. ID. NO. 271)
```
ATGAAAGACTTGTTTTTAAAGAGAAAGCAGGCCTTTCGTAAGGAGTGTCTTGGTTATCTGCGCTATGTGCTCAATG
ACCACTTTGTCTTGTTCCTGCTTGTCCTGTTGGGCTTTCTAGCCTACCAGTACAGTCAACTCTTACAACATTTTCCT
GAAAATCATTGGCCTATCCTTTTGTTTGTAGGAATTACGTCTATTTTACTTTGGGGAGGAACTGCCACCTA
TATGGAGGCTCCAGACAAGCTCTTTCTCTTAGTTGGAGAAGAGGAAATTAAGCTCCATCTCAAGCGTCAAACTGG
CATTTCCCTAGTCTTTTGGCTCTTTGTACAGACCCTTTTCTTGCTGTTATTTGCGCCTTTATTTTTAGCAATGGGTTA
TGGCTTGCCAGTTTTTCTGCTCTATGTGCTTTTATTGGGGGTAGGAAAATATTTCCACTTTTGTCAAAAGGCCAGCA
AATTTTTCACTGAAACTGGACTGGACTGGGACTATGTTATTTCTCAAGAAAGCAAGCGTAAGCAAGTCTTGCTTCG
TTTCTTTGCCCTCTTTACGCAGGTCAAGGGAATTTCAAACAGCGTTAAGCGTCGTGCCTATCTGGACTTTATTTTAA
AGGCTGTTCAGAAGGTGCCTGGGAAGATTTGGCAAAATCTCTATCTGCGTTCTTATCTGCGAAATGGCGACCTCTT
TGCTCTCAGTCTTCGTCTTCTCTTGCTTTG=CCTTGCTGGCGCAGGTTTTTATCGAGCAAGCTTGGATTGCGACAGCAG
TGGTAGTTCTCTTTAACTACCTCTTGCTCTTCCAGTTGCTGGCCCTCTATCATGCCTTTGACTACCAGTATTTGACC
CAACTCTTTCCGCTGGACAAGGGGCAAAAGGAAAAAGGCTTACAGGAGGTAGTTCGAGGATTGACCAGTTTTGTT
TTACTTGTGGAATTAGTTGTTGGGTTGATTACCTTCCAAGAAAAACTAGCCCTTCTAGCCTTACTAGGAGCTGGTT
TGGTTTTACTAGTCTTGTATTTGCCTTATCAGGTAAAACGTCAGATGCAGGACTAA
```

4258.2                                                                (SEQ. ID. NO. 272)
```
ATGAGAAAATCAATAGTATTAGCGGCAGATAATGCCTATCTTATTCCTTTAGAGACGACTATAAAGTCTGTATTGT
ATCACAATAGAGATGTTGATTTTTATATTCTCAACAGTGATATAGCTCCTGAATGGTTTAAATTATTGGGGAGAAA
AATGGAAGTTGTGAATTCTACAATTCGCAGTGTACACATTGATAAAGAACTTTTTGAAAGCTATAAAACAGGACCT
CATATAAATTATGCTTCTTACTTTAGATTTTTTGCGACAGAAGTGGTTGAATCTGATAGGGTATTGTATCTGGATTC
CGATATCATTGTAACTGGGGAACTAGCTACTTTGTTTGAGATAGATCTCAAAGGATATTCAATTGGTGCTGTTGAT
GATGTCTATGCCTATGAAGGACGAAATCTGGATTTAATACTGGTATGTTACTAATGGATGTTGCAAAGTGGAAAG
AACATTCTATTGTCAATAGTTTATTGGAATTAGCGGCCGAGCAGAATCAAGTTGTTCATCTTGGGGATCAGAGTAT
TTTAAATATTTATTTTGAGGATAATTGGCTAGCCTTAGATAAAACATATAATTATAATGGTGGGTATTTGATATTTATC
ACCTTGCTCAAGAATGTGAACGTCTAGATGACAATCCACCTACAATTGTTCACTATGCTAGTCATGATAAACCTTG
GAATACATATGTATATCTAGACTACGTGAATTATGGTGGGTTTATAGAGATTTGGATTGGTCAGAGATTGCTTTT
CAACGTTCCGATTTAAATTATTTTGAAAGAAGCAATCAGTCTAAAAAACAAGTGATGCTTGTGACATGGAGTGCA
GATATAAAACATTTAGAGTATTTAGTACAACGGTTACCTGATTGGCATTTTCATTTGGCTGCACCGTGTGATTGTTC
TGAGGAGCTGACCTCTCTATCACAGTATACGAATGTAACAGTATATCAAAATGTATTACATAGTAGAATTGATTGG
CTATTGGACGATTCTATAGTTTATTTAGATATTAATACAGGTGGAGAGGTTTTAATGTAGTTACAAGGGCACAAG
AAAGTGGCAAGAAAATCTTCGCTTTTGATATCACACGTAAAGTATGGATGATGGACTCTATGACGGTATTTTTTC
TGTGGAGAGACCAGATGATTAGTGGATAGAATGAAGAATATAGAGATAGAGTAA
```

4158.2                                                                (SEQ. ID. NO. 273)
```
ATGACTAAGATTTATTCGTCAATAGCAGTAAAAAAAGGACTATTTACCTCATTTCTACTGTTTATCTATGTATTGG
GAAGTCGTATTATTCTCCCTTTTGTTGACCTAAATACTAAAGATTTTTTAGGAGGTTCAACAGCCTATCTAGCCTTC
TCAGCCGCCCTAACAGGTGGGAATCTAAGAAGTTTATCAATTTTTTTCTGTTGGATTATCCCCTTGGATGTCCGCCA
TGATTTATGGCAGATGTTTCTTTTTCTAAACGGTTGGGTTTAACATCTACGTCTATAGAAATACAAGATCGCCGT
AAAATGTACCTGACCTTGCTAATTGCTGTGATTCAATCCTTGGCAGTTAGCTTGAGACTGCCAGTACAATCCTCCT
ATTCTGCAATATTGGTTGTTCTAATGAATACAATATTGCTGATAGCAGGAACATTTTTTCTTGTTTGGTTGTCAGAT
TTAAATGCGAGTATGGGGATTGGAGGTTCTATTGTAATCCTCCTATCCAGTATGGTTTTAAATATTCCTCAGGATG
```

TABLE 1-continued

TTTTGGAAACATTTCAGACAGTACACATTCCAACAGGGATTATTGTGTTACTTGCTTTATTAACCCTTGTCTTTTCT
TATTTACTTGCCCTTATGTATCGAGCTCGCTATTTGGTTCCTGTTAATAAAATTGGCTTACACAATCGATTTAAACG
CTATTCTTATCTCGAAATCATGTTGAATCCTGCAGGTGGGATGCCTTATATGTATGTGATGAGTTTTCTTAGTGTAC
CAGCTTATTTGTTCATCTTGTTGGGATTTATTTTCCCTAATCATTCAGGGTTAGCGGCTTTATCAAAGGAATTTATG
GTTGGAAAGCCTTTGTGGGTCTATGTTTATATTTCGGTCTTATTTTTATTTAGTATCATTTTTGCTTTTGTTACGATG
AATGGAGAAGAGATTGCAGACCGTATGAAAAAATCTGGAGAATACATTTATGGTATTTATCCAGGTGCGGATACT
AGTCGATTTATTAATCGATTGGTCCTTCGTTTCTCAGTCATAGGTGGTCTCTTTAATGTGATTATGGCAGGTGGTCC
CATGCTTTTTGTTTTGTTTGATGAAAAGTTATTACGATTGGCAATGATTCCAGGCTTATTTATGATGTTCGGGGGCA
TGATTTTTACGATTAGAGACGAGGTCAAGGCTTTAAGGCTAAATGAGACCTATAGACCTTTGATTTAG 4158.3                                                              (SEQ. ID. NO. 274)
ATGTCCTCTCTTTCGGATCAAGAATTAGTAGCTAAAACAGTAGAGTTTCGTCAGCGTCTTTCCGAGGGAGAAAGTC
TAGACGATATTTTGGTTGAAGCTTTTGCTGTGGTGCGTGAAGCAGATAAGCGGATTTTAGGGATGTTTCCTTATGA
TGTTCAAGTCATGGGAGCTATTGTCATGCACTATGGAAATGTTGCTGAGATGAATACGGGGGAAGGTAAGACCTT
GACAGCTACCATGCCTGTCTATTTGAACGCTTTTTCAGGAGAAGGAGTGATGGTTGTGACTCCTAATGAGTATTTA
TCAAAGCGTGATGCCGAGGAAATGGGTCAAGTTTATCGTTTTCTAGGATTGACCATTGGTGTACCATTTACGGAAG
ATCCAAAGAAGGAGATGAAAGCTGAAGAAAAGAAGCTTATCTATGCTTCGGATATCATCTACACAACCAATAGTA
ATTTAGGTTTTGATTATCTAAATGATAACCTAGCCTCGAATGAAGAAGGTAAGTTTTTACGACCGTTTAACTATGT
GATTATTGATGAAATTGATGATATCTTGCTTGATAGTGCACAAACTCCTCTGATTATTGCGGGTTCTCCTCGTGTTC
AGTCTAATTACTATGCGATCATTGATACACTTGTAACAACCTTGGTCGAAGGAGAGGATTATATCTTTAAAGAGGA
GAAAGAGGAGGTTTGGCTCACTACTAAGGGGGCCAAGTCTGCTGAGAATTTCCTAGGGATTGATAATTTATACAA
GGAAGAGCATGCGTCTTTTGCTCGTCATTTGGTTTATGCGATTCGAGCTCATAAGCTCTTTACTAAAGATAAGGAC
TATATCATTCGTGGAAATGAGATGGTACTGGTTGATAAGGGAACAGGGCGTCTAATGGAAATGACTAAACTTCAA
GGAGGTCTCCATCAGGCTATTGAAGCCAAGGAACATGTCAAATTATCTCCTGAGCACGGGCTATGCCTCGATC
ACCTATCAGAGTCTTTTTAAGATGTTTAATAAGATATCTGGTATGACAGGGACAGGTAAGGTCGCGGAAAAAGAG
TTTATTGAAACTTACAATATGTCTGTAGTACGCATTCCAACCAATCGTCCGAGACAACGGA
TTGACTATCCAGATAATCTATATATCACTTTACCTGAAAAAGTGTATGCATCCTTGGAGTACATCAAGCAATACCA
TGCTAAGGGAAATCCTTTACTCGTTTTTGTAGGCTCAGTTGAAATGTCTCAACTCTATTCGTCTCTCTTGTTTCGTG
AAGGGATTGCCCATAATGTCCTAAATGCTAATAATGCGGCGCGTGAGGCTCAGATTATCTCCGAGTCAGGTCAGA
TGGGGGCTGTGACAGTGGCTACCTCTATGGCAGGACGTGGTACGGATATCAAGCTTGGTAAAGGAGTCGCAGAGC
TTGGGGGCTTGATTGTTATTGGGACTGAGCGGATGGAAAGTCAGCGGATCGACCTACAAATTCGTGGCCGTTCTGG
TCGTCAGGGAGATCCTGGTATGAGTAAATTTTTTGTATCCTTAGAGGATGATGTTATCAAGAAATTTGGTCCATCT
TGGGTGCATAAAAAGTACAAAGACTATCAGGTTCAAGATATGACTCAAGGAGTATTGAAAGGTCGTAAATAC
CGGAAACTAGTCGAAAAGGCTCAGCATGCCAGTGATAGTGCTGGACGTTCAGCACGTCGTCAGACTCTGGAGTAT
GCTGAAAGTATGAATATACAACGGGATATAGTCTATAAAGAGAGAAATCGTCTAATAGATGGTTCTCGTGACTTA
GAGGATGTTGTTGTGGATATCATTGAGAGATATACAGAAGAGGTAGCGGCTGATCACTATGCTAGTCGTGAATTAT
TGTTTCACTTTATTGTGACCAATATTAGTTTTCATGTTAAAGAGGTTCCAGATTATATAGATGTAACTGACAAAACT
GCAGTTCGTAGCTTTATGAAGCAGGTGATTGATAAAGAACTTTCTGAAAAGAAAGAATTACGTTAATCAACATGACT
TATATGAACAGTTTTTACGACTTTCACTGCTTAAAGCCATTGATGACAACTGGGTAGAGCAGGTAGACTATCTACA
ACAGCTATCCATGGCTATCGGTGGTCAATCTGCTAGTCAGAAAAATCCAATCGTAGAGTACTATCAAGAAGCCTA
CGCGGGCTTTGAAGCTATGAAAGAACAGATTCATGCGGATATGGTGCGTAATCTCCTGATGGGGCTGGTTGAGGT
CACTCCAAAAGGTGAAATCGTGACTCATTTTCCATAA 4158.4                                                              (SEQ. ID. NO. 275)
ATGATAGGGACTTTCGCCGCTGCTCTTGTAGCTGTACTAGCAAATTTCATCGTCCCTATTGAAATTACCCCAAATA
GTGCCAATACTGAAATTGCACCACCAGATGGGATTGGGCAGGTTCTCAGCAACCTCTTGCTCAAACTGGTTGACA
ACCCAGTCAACGCCCTGCTTACTGCTAACTATATTAGAATCTTATCTTGGGCAGTCATTTTTGGAATCGCTATGAG
AGAAGCCAGTAAAAATAGTCAAGAATTGCTAAAAACTATCGCTGACGTGACTTCTAAAATTGTCGAATGGATCAT
CAATCTGGCTCCATTTGGAATCCTTGGTCTTGTTTTTAAAACCATTTCTGACAAGGGAGTCGGAAGCCTTGCCAAC
TACGGTATTTTATTGGTTCTATTAGTAACGACTATGCTTTTTGTTGCCCCTGTGGTCAACCCTTTGATTGCCTTCTTC
TTTATGAGACGCAATCCTTACCCTCTAGTTTGGAACTGCCTCCGTGTCAGCGGTGTGACAGCCTTTTTCACTCGTA
GTTCTGCGACTAACATTCCTGTCAACATGAAACTCTGCCATGACCTTGGACTCAACCCAGATACCTATTCTGTTTC
TATCCCACTCGGTTCTACTATCAATATGGCTGGAGTAGCGATTACCATTAACCTTTTGACCCTTGCTGCAGTTAAC
ACTCTTGGAATTCCTGTTGACTTTGCCACAGCCTTTGTCCTCAGTGTGGCTGTCGCTGATCTCATCCTGTGATGCTTC
AGGTATTGCCGGAGGTTCCCTCCTTCTTATCCCAGTTGCTTGGCCTTTTCGGTATTTCTAACGATATTGCCATAC
AAAATTGTTGGGGTTGGTTTTGTGATTGGTGTCATCCAAGACTCATGTGAAACAGCCCTTAACTCTTCTACAGATGT
CCTCTTTACCGCCGTTGCCGAATACGCAGCAACCCGTAAAAAATAA 4158.5                                                              (SEQ. ID. NO. 276)
ATGTCTATTAGCCAACGTACGACCAAGCTCATCTTAGCTACCTGTCTTGCCTGCCTGCTTGCTTATTTTCTCAATCT
TTCGTCAGCAGTTTCGGCTGGAATTATCGCTCTCTTGAGCCTATCTGATACGCGTAGAAGTACTTTAAAACTGGCT
CGCAATCGTCTTTTTCTATGCTTCTAGCTCTGGCTATCCGTGTTCTAGCTTTTCTGAGCGGATTTCATATCTG
GAGTCTCGGCCTCTATCTGGCCTTCTACGTTCCTTTAGCCTACAAGATGGGCTGGGAAATTGGCATCACACCAAGC
ACTGTTTTGGTTAGCCATCTCTTGGTTCAAGAGTCAACCTCTCCAGACCTTCTAGTCAATGAATTCCTTCTCTTTGC
TATTGGTACAGGATTTGCCTTGCTTGTTAATCTCTATATGCCTTCACGAGAAGAGGAAATCCAGCACTACCACACG
CTGGTGGAAGAAAAGTTAAAAGATATCCTCCAGCGCTTCAAATACTATTTATCCAGAGGAGACGGACGAACCGA
GCACAGCTGGTAGCAGAATTAGACACGCTTTTGAAAGAAGCCCTCAGACTGGTCTATTTGGATCACTCTGACCACC
TCTTTCACCAGACAGACTACCATATCCACTACTTTGAGATGAGACAGCGACAAAGTCGTATCCTGAGAAACATGG
CCCAACAGATTAACACTTGTCACCTTGCCGCCAGTGAAAGCCTGATCTTAGCGCAACTCTTTTCAAAAATTGCAGG
TCAACTGAGCCAGACCAATCCTGCTTCTGATTTGCTAGATGAAATTGAACGTTATCTGGAAGTCTTCCGGAACCGC
AGTCTGCCCAAGACAAGAAGAAGAATTTGAAACCCGCGCCACCCTTCTTCAACTCCTACGTGAAGCCAAAACCTTC
ATCCAAGTAAAAGTTGATTTTTACCAAAAATATAGACAGTAA 4158.6                                                              (SEQ. ID. NO. 277)
ATGGAAATCATGTCGCTTGCGATTGCTGTTTTTGCCGTCATCATTGGTTTAGTCATTGGATATGTCAGCATCTCAGC
TAAGATGAAATCATCTCAGGAAGCTGCAGAGTTGATGCTTTTAAATGCTGAACAAGAAGCAACTAATTTACGTGG
ACAAGCTGAGCGTGAAGCGGATTTACTTGTTAATGAAGCCAAACGTGAAAGCAAGTCTCTTAAAAAAGAAGCACT
ATTGGAGGCCAAAGAAGAAGCCAGAAAATACCGTGAAGAAGTGGACGCTGAATTCAAATCAGAACGTCAAGAAC
TCAAACAAATCGAAAGTCGTTTGACAGAGAGAGCTACTAGCCTTGACCGTAAGGACGACAATTTGACGAGTAAAG

TABLE 1-continued

```
AACAAACACTTGAACAAAAAGAACAAAGTATTTCTGATAGAGCGAAAAACCTTGATGCGCGTGAAGAGCAATTAG
AGGAAGTCGAAAGACAAAAAGAAGCAGAACTAGAGCGTATTGGTGCGCTGTCTCAGGCAGAAGCACGAGATATT
ATCTTGGCTCAGACAGAGGAAAACTTGACCAGGGAGATTGCCAGTCGCATTCGCGAAGCTGAGCAAGAGGTCAAG
GAACGTTCTGACAAAATGGCCAAGGACATCTTGGTTCAAGCTATGCAACGTATCGCTGGTGAATATGTAGCGGAG
TCAACAAACTCAACAGTTCATCTGCCAGACGATACTATGAAGGGACGCATTATTGGTCGTGAAGGTCGTAACATT
CGTACCTTTGAAAGTTTGACAGGGGTCGATGTGATTATCGACGATACACCAGAAGTGGTGACCTTGTCAGGATTTG
ATCCGATTCGTCGTGAGATTGCCCGTATGACTATGGAAATGTTGCTCAAAGATGGTCGTATACATCCAGCTCGTAT
CGAAGAGTTGGTTGAGAAAAACCGTCAAGAGATTGACAATAAGATTCGTGAATACGGTGAGGCTGCTGCCTATGA
AATTGGTGCGCCAAACCTTCATCCAGACTTGATGAAGATTATGGGACGTTTGCAGTTCCGTACTTCATATGGACAA
AATGTTTTGCGCCATTCGATTGAGGTTGCTAAGTTGGCTGGTATCATGGCGAGCGAACTTGGTGAAAATGCGGCTC
TTGCCCGTCGTGCTGGATTCCTTCACGATATCGGGAAAGCCATTGACCATGAGGTTGAAGGTAGCCACGTTGAAAT
CGGTATGGAATTGGCCCGTAAGTACAAGGAACCCCCAGTTGTGGTGAATACGATTGCTAGTCACCACGGAGATGT
TGAAGCTGAGAGCGTGATAGCAGTTATCGTCGCTGCAGCAGATGCCTTGAGCGCAGCCCGTCCAGGTGCTCGTAG
TGAGTCTCTTGAAAGCTACATCAAGCGTCTCCATGATTTGGAAGAAATTGCTAACGGCTTTGAAGGAGTGCAAACT
AGCTTTGCCCTTCAAGCAGGACGTGAAATTCGTATCATGGTCAATCCAGGAAAAATCAAGGACGACAAAGTCACA
ATCTTGGCTCACAAAGTTCGTAAGAAAATTGAAAACAATCTCGATTATCCAGGAAATATCAAGGTAACCGTGATT
CGCGAGCTTCGTGCAGTAGATTATGCTAAATAA 4158.7                                                          (SEQ. ID. NO. 278)
ATGATGTTAAAACCCTCTATTGATACCTTGCTCGACAAGGTTCCTTCAAAATATTCACTCGTAATCTTGGAAGCAA
AACGTGCCCACGAATTGGAAGCAGGTGCCCCAGCAACTCAAGGTTTCAAGTCTGAAAAATCAACTCTTCGCGCTT
TAGAAGAAATCGAATCAGGAAACGTTACAATTCACCCAGATCCAGAAGGAAAACGTGAAGCAGTGCGTCGCCGTA
TCGAAGAAGAAAACGCCGCAAAGAAGAAGAAGAAAAGAAAATCAAAGAGCAAATTGCTAAAGAAAAAGAAGA
TGGTGAAAAAATTTAA 4161.1                                                          (SEQ. ID. NO. 279)
ATGTCAGCATATCAATTACCGACCGTATGGCAGGATGAAGCTAGTAATCAAGGAGCTTTTACGGGGCTAAACAGA
CCAACAGCAGGTGCCCGTTTCGAACAAAACTTGCCAAAAGGAGAACAAGCTTTTCAGCTTTATTCACTGGGAACA
CCAAATGGTGTGAAGGTTACTATCTTATTGGAAGAATTACTAGAAGCTGGTTTTAAGGAAGCGGCTTACGACTTGT
ATAAGATTGCTATCATGGATGGGGATCAATTCGGATCAGACTTTGTGAAGCTCAATCCAAATTCCAAGATTCCAGC
CTTACATTGGACCAGTCAGGTACTGAAAACGTAAGAGTCTTTGAGTCTGCTCATATTCTTCTTTACCTTGCTGAGAAA
TTTGGAGCCTTTTTACCAAGTAATCCTGTGGAAAAGGTAGAAGTTTTGAATTGGCTATTCTGGCAAGCAGGTGCAG
CACCTTTTCTAGGTGGGGATTTGGACATTTCTTCAATTATGCTCCTGAAAAATTGGAATATCCTATTAACCGTTTT
ACGATGGAAGTGAAACGCCAGTTGGATTTATTGGATAAGGAATTGGCTCAGAAACCTTATATTGCAGGCAATGAC
TATACGATTGCAGATATTGCTATCTGGTCTTGGTATGGACAGTTAGTTCAAGGAAATCTTTACCAAGGTTCTGCAA
AATTCTTGGATGCCTCAAGTTATCAAAATCTAGTAAAATGGGCAGAAAAAATTGCCAATCGTCCAGCTGTTAAGC
GTGGCTTGGAAGTAACTTATACAGAAATTAAATAG 4161.2                                                          (SEQ. ID. NO. 280)
TTGGCAAGCTTGATCACTTCTATCATCATGTTCTATGTCGGTTTCGATGTTCTAAGAGATACCATTCAAAAGATTCT
CAGTCGGGAAGAAACGGTCATTGATCCTCTTGGTGCAACTCTAGGAATCATTTCTGCAGCGATTATGTTTGTGGTC
TATCTCTACAATACTCGCCTCAGTAAGAAATCCAACTCCAATGCGCTCAAGGCAGCTGCTAAGGACAATCTTTCTG
ACGCTGTTACCTCACTTGGAACCGCCATTGCCATCCTAGCTAGTAGTTTCAATTATCCGATTGTGGATAAACTGGT
TGCTATCATCATCACTTTCTTTATCTTGAAGACTGCCTATGATATCTTCATCGAGTCTTCCTTTAGTCTTTCAGATG
GCTTTGACGACCGCCTGCTCGAGGACTACCAAAAGGCTATCATGGAAATTCCCAAAATCAGCAAGGTCAAATCGC
AAAGAGGTCGCACCTACGGTAGCAACATCTACCTGGATATTACACTAGAGATGAATCCTGACTTGTCTGTTTTTGA
AAGCCATGAAATCGCGGATCAGGTCGAGTCTATGCTGGAGGAGCGTTTTGGCGTCTTTGATACCGATGTCCATATC
GAACCAGCACCTATCCCTGAGGATGAAATTTTAGACAATGTCTATAAAAAATTGCTTATGCGTGAACAATTGATTG
ACCAAGGAAACCAACTAGAAGAACTCTTGACTGATGATTTTGTCTATATTCGCCAAGATGGAGCAGATGGATA
AAGAGGCTTATAAGACCAAAAAAGAGTTAAATTCTGCTATCAAGGACATTCAAATTACTTCCATCAGTCAAAAAA
CCAAACTCATCTGCTATGAGTTAGATGGTATCATCCATACCAGTATCTGGCGTCGCCACGAAACCTGGCAAAATAT
CTTTCATCAAGAAACCAAAAAAGAATAG 4162.1                                                          (SEQ. ID. NO. 281)
ATGACAATTAAAACTAGTAGCAACGGATATGGACGGAACCTTCCTAGATGGGAATGGACGCTTTGATATGGATCGT
CTCAAGTCTCTCTTGGTTTCCTACAAGGAAAAAGGGATTTACTTTGCGGTAGCTTCGGGTCGGGATTTCTGTCTC
TAGAAAAATTATTTGCTGGTGTTCGTGATGACATTATTTTCATCGCGGAAAATGGCAGTTTGGTAGAGTATCAAGG
TCAGGACTTGTATGAAGCGACTATGTCTCGTGACTTTTATCTGGCACTTTTGAAAGCTGTTCGAAAACTTCACCTTAT
GTAGATATCAATAAACTGCTCTTGACGGGTAAGAAGGGTTCATATGTTCTAGATACGGTTGATGAGACCTATTTGA
AAGTGAGTCAGCACTATAATGAAAATATCCAAAAAGTAGCGAGTTTGGAAGATATCACAGATGACATTTTCAAAT
TTACAACCAACTTCACAGAAGAAACGCTGGAAGATGGGGAGGCTTGGGTAAACGAAAACGTTCCTGGTGTTAAGG
CCATGACAACTGGCTTTGAATCCATTGATATTGTTCTGGACATATGTCGATAAAGGGAGTGGCCATTGTTGAATTAGT
TAAAAAACTTGGTATCACAATGGATCAGGTCATGGCTTTTGGAGACAATCTTAATGACTTACATATGATGCAGGTT
GTGGGACATCCTGTAGCTCCTGAAAATGCACGACCTGAAATTTAGAATTAGCAAAGACTGTGATTGGTCACCATA
AGGAACGGTCGGTTATAGCTTATATGGAGGGCTTATAA 4162.2                                                          (SEQ. ID. NO. 282)
ATGGCAGATATAAAATTGATTGCATTGGACTTGGACGGGACCTTGCTGACTACTGATAAAAGGCTGACGGATCGT
ACCAAGGAAACCTTGCAAGCTGCGCGTGATCGTGGTATCAAGGTCGTATTGACAACTGGTCGTCCCTTAAAAGCC
ATGGATTTCTTTCTCCATGAGTTAGGGACTGACGGTCAGGAAGATGATACCATTACTTTTAATGGTGGATTAG
TTCAGAAAAATACAGGAGAAATCCTTGATAAAACAGTCTTTTCATATGATGATGTGGCACGTTTGTATGAAGAAC
AGAGAAATTATCACTGCCTCTTGATGCCATCTCAGAAGGAACAGTTTATCAAATCCAATCGGACCAAGAAAGTCT
TTATGCCAAATTCAATCCAGCTTTGACCTTTGTTCCAGTGGACTTTGAAGACTTATCTAGTCAAATGACCTACAAC
AAATGCGTGACTGCCTTTGCTCAAGAACCCTTGGATGCAGCCATTCAGAAGATTTCTCCAGAATTGTTTGACCAAT
ATGAAATCTTTAAATCACGTGAAATGTTGCTAGAATGGTCACCAAAGAATGTTCATAAAGCAACAGGTTTGGCAA
AACTAATCAGCCATCTTGGAATCGACCAAAGTCAAGTGATGGCTTGTGGTGACGAGGCCAATGACCTCTCTATGA
TTGAATGGGCAGGTCTTGGTGTTGCTATGCAAAACGCTGTTCCTGAAGTAAAGGCAGCCGCAAATGTAGTGACGC
CGATGACCAACGATGAGGAAGCTGTCGCCTGGGCTATCGAAGAATATGTGCTAAAGGAGAACTAA
```

TABLE 1-continued 4164.2 (SEQ. ID. NO. 283)
ATGGAAAGTTTACTTATTCTATTATTAATTGCCAATCTAGCTGGTCTCTTTCTGATTTGGCAAAGGCAGGATAGGC
AGGAGAAACACTTAAGTAAGAGCTTGGAGGATCAGGCAGATCATTTGTCAGACCAGTTGGATTACCGCTTTGACC
AAGCCAGACAAGCCAGCCAGTTAGACCAAAAAGATTTGGAAGTGGTTGTCAGCGACCGTTTGCAAGAAGTGCGGA
TTGAATTGCACCAAGGTCTGACCCAAGTCCGTCAAGAAATGACAGATAATCTCCTCCAAACTAGAGACAAGACAG
ACCAACGTCTCCAAGCCTTGCAGGAATCAAATGAGCAACGTTTGGAACAAATGCGCCAGACGGTCGAGGAAAAC
TAGAAAAGACCTTGCAGACACGCTTACAGGCTTCCTTTGAGACAGTTTCTAAACAACTGGAGTCTGTCAATCGTGG
CCTTGGAGAAATGCAGACAGTTGCCCGTGATGTCGGAGCTCTTAACAAGGTTCTCTCTGGAACCAAGACGCGAGG
GATTCTGGGAGAATTGCAACTGGGGCAAATTATTGAAGACATCATGACACCTGCCCAGTACGAACGAGAATACGC
AACGGTTGAAAACTCTAGTGAACGAGTGGAGTATGCCATCAAGTTACCCGGACAAGGCGACCAAGAATACGTCTA
TCTGCCAATTGACTCTAAGTTTCCACTGGCAGATTATTACCGCTTGGAAGAAGCCTATGAGACAGGTGACAAGGAT
GAGATTGAACGCTGTCGTAAGTCACTCCTAGCAAGCGTCAAGCGCTTTGCTAGGGATATTAGGAACAAGTACATA
GCACCACCTCGGACGACCAATTTTGGAGTTTTGTTTGTTCCGACAGAAGGTCTCTACTCAGAAATCGTCCGCAATC
CGGTCTTCTTTGATGATTTGAGACGGGAAGAACAGATTATTGTTGCAGGACCAAGTACCCTATCAGCCCTTCTTAA
CTCCCTATCAGTTGGTTTCAAGACCCTTAATATCCAAAAGAGTGCCGACCATATCAGCAAGACTCTTGCCAGTGTC
AAGACCGAGTTTGGCAAGTTTGGTGGTATTCTGGTCAAGGCACAAAAACATCTCCAACATGCCTCTGGCAATATTG
ATGAATTATTAAACCGTCGTACCATAGCTATCGAGCGGACGATCCGTCACATTGAGTTGTCAGAAGGTGAGCCTGC
GCTTGATCTACTCCATTTTCAAGAAAATGAGGAAGAATATGAAGATTAG 4164.3 (SEQ. ID. NO. 284)
ATGAAGATTAGTCACATGAAAAAAGATGAGTTATTTGAAGGCTTTTACCTAATCAAATCAGCTGACCTGAGGCAA
ACTCGAGCTGGGAAAAACTACCTAGCCTTTACCTTCCAAGATGATAGTGGCGAGATTGATGGGAAGCTCTGGGAT
GCCCAACCTCATAACATTGAGGCCTTTACCGCAGGTAAGGTTGTCCACATGAAAGGACGCCGAGAAGTTTATAAC
AATACCCCTCAAGTCAATCAAATTACTCTCCGCCTGCCTCAAGCTGGTGAACCCAATGACCCAGCTGATTTCAAGG
TCAAGTCACCAGTTGATGTCAAGGAAATTCGTGACTACATGTCGCAAATGATTTTCAAAATTGAAAATCCTGTCTG
GCAACGGATTGTCCGAAATCTCTACACCAAGTATGATAAGGAATTCTACTCCTATCCAGCTGCCAAGACCAACCA
CCATGCCTTTGAAACGGGCTTGGCCTATCATACGGCGACCATGGTGCGTTTGGCAGACGCTATTAGCGAAGTTTAT
CCTCAGCTCAATAAGAGCCTGCTCTATGCGGGGATTATGTTGCATGACTTAGCTAAGGTCATCGAGTTGACGGGGC
CAGACCAGACAGAGTACACAGTGCGAGGTAATCTTCTTGGACATATCGCTCTCATTGATAGCGAAATTACCAAGA
CAGTTATGGAACTCGGCATCGATGATACCAAGGAAGAAGTCGTTTTGCTTCGTCATGTCATCCTCAGTCACCACGG
CTTGCTTGAGTATGGAAGCCCAGTCCGTCCACGCATTATGGAAGCAGAGATTATCCATATGATTGACAATCTGGAT
GCAAGCATGATGATGATGTCAACAGCTCTTGCTTTGGTGGATAAAGGAGAGATGACCAATAAAATCTTCGCTATG
GATAATCGTTCCTTCTATAAACCAGATTTAGATTAA 4166.2 (SEQ. ID. NO. 285)
ATGAGTGAAAAAGCTAAAAAAGGGTTTAAGATGCCTTCATCTTACACCGTATTATTGATAATCATTGCTATTATGG
CAGTGCTAACTTGGTTTATCCCTGCGGGGGCCTTTATAGAAGGTATTTACGAGACTCAGCCTCAAAATCCACAAGG
GATTTGGGATGTCCTGATGGCACCGATTCGGGCTATGCTAGGTACTCATCCAGAGGAAGGTTCGCTCATTAAAGAA
ACGAGCGCAGCGATTGATGTAGCCTTCTTCATCCTTATGGTTGGTGGTTTCCTTGGCATTGTCAACAAAACTGGTG
CTCTTGACGTAGGGATTGCCTCTATCGTGAAGAAGTATAAGGGCCGCGAAAAAATGTTAATTTTGGTACTGATGCC
TTTGTTTGCCCTCGGTGGTACAACTTATGGTATGGGTGAAGAAACAATGGCCTTCTATCCACTCCTTGTGCCAGTT
ATGATGGCCGTTGGTTTTGATAGCCTGACTGGTGTTGCAATTATTTTGCTCGGTTCTCAAATCGGCTGTTTGGCATC
TACTCTGAATCCATTTGCGACAGGTATTGCTTCAGCGACTGCGGGAGTTGGTACAGGGGACGGTATCGTACTTCGT
CTGATCTTCTGGGTTACCTTGACTGCTCTTAGTACTTGGTTTGTTTACCGTTATGCGGATAAGATTCAAAAAGATCC
GACTAAGTCACTGGTTTATAGTACTCGCAAAGAAGATTTGAAACACTTTAACGTAGAAGAATCTTCATCTGTAGAA
TCTACACTTAGCAGCAAACAAAAATCAGTTCTCTTCTTATTTGTGTTGACATTCATCTTGATGGTATTGAGCTTCAT
TCCATGGACAGACCTTGGCGTTACCATTTTTGATGACTTTAATACTTGGTTGACTGGTCTTCCAGTTATTGGTAATA
TTGTCGGTTCATCTACTTCTGCACTAGGTACTTGGTACTTCCCAGAAGGCGCAATGCTCTTTGCCTTTATGGGTATC
CTGATTGGTGTTATTTATGGTCTTAAAGAAGATAAGGATTATCTTCCTTCATGAATGGTGCTGCTGACTTGCTCAG
TGTTGCCTTGATCGTAGCGATTGCTCGTGGTATTCAAGTTATCATGAACGACGGTATGATTACCGATACAATCCTC
AACTGGGGTAAAGAAGGCTTGAGCGGTCTATCTTCACAAGTCTTTATCGTTGTAACTTTATATCTTCTATCTACCTAT
GTCATTCTTGATCCCATCTTCATCTGGTCTTGCCAGCGCAACTATGGGTATCATGGC
TCCACTTGGAGAATTTGTAAATGTCCGTCCTAGCTTGATTATCACTGCTTACCAATCTGCTTCAGGTGTCTTGAACT
TGATTGCACCAACATCTGGTATTGTGATGGGAGCTCTTGCACTTGGACGTATCAACATTGGTACTTGGTGGAAATT
CATGGGCAAACTCGTAGTCGCTATTATTGTAGTGACCATCGCCCTTCTTCTCCTTGGAACCTTCCTTCCATTCCTAT
AA 4166.3 (SEQ. ID. NO. 286)
ATGAAAATAGATATAACAAATCAAGTTAAAGATGAATTTCTTATATCATTAAAAAACCTTGATTTCCTATCCTTCAG
TACTCAATGAAGGAGAAAATGAACACCTTTTGGACAAGCAATCCAAGATGTCTCAGAAAAAACTTTAGAGATTT
GTCGAGACATAGGTTTCACTACCTATCTTGACCCTAAAGGTTATTACGGATATGCAGAAATCGGTCAGGGAGCAG
AGCTTCTGGCCATTCTCTGTCATTTGGATGTTGTTCCATCAGGTGATGAAGCAGATTGGCAGACACCGCCATTTGA
AGCAACTATCAAAGACGGCTGGGTATTCGGACGTGGTGTCCAAGATGATAAAGGCCCTTCGCTCGCAGCTCTCTA
TGCAGTAAAAAGCTTGCTGGACCAAGGTATTCAGTTCAAAAAGCGCGTACGCTTTATCTTTGGTACCGATGAGGA
AACCCTCTGGCGCTGCATGGCACGCTACAATACCATCGAAGAACAGGCCAGTATGGGCTTTGCACCTGACTCATC
TTTTCCTCTGACCTATGCTGAAAAAGGGCTTCTACAGGTCAAACTTCATGGCCCTGGATCGGATCAACTAGAGCTT
GAAGTAGGAGGCGCCTTTAACGTTGTACCAGACAAGGCCAACTACCAAGGTCTCCTCTATGAACAGGTTTGTAAC
GGTCTCAAAGAAGCTGGTTATGATTACCAAACCACTGAACAAACCGTAACGGTTCTCGGAGTGCCAAAGCATGCT
AAGGATGCTAGTCAAGGTATCAATGCTGTCATCCGACTAGCTACCATTCTTGCTCCTCTCCAAGAACACCCTGCTC
TCAGTTTTCTTGCAACACAAGCAGGTCAAGCACGGCACAGGAAGACAAATATCTTTGGTGATATAGCAGATGAACCTT
CTGGTCACCTATCCCTTTAATGTCGCAGGTCTCATGATCAATCATGAACGTTCTGAAATCCGTATTGACATTCGGAC
TCCTGTCTTAGCTGACAAGGAAGAACTAGTAGAGTTGCTTACAAGATGTGCACAAAACTACCAACTCCGCTACGA
AGAGTTTGACTATCTAGCGCCTCTATACGTCGCAGAAGACAGTAAACTCGTTAGCACACTGATGCAAATCTACCA
AGAAAAGACTGGCGATAACAGTCCTGCTATTTCATCCGGTGGTGCCACTTTTGCTCGCACCATGCCAAATTGTGTA
GCCTTCGGCGCCTTATTCCCAGGAGCGAAGCAGACAGAACATCAGGCAAATGAATGTGCCGTTCTAGAAGATTTG
TACCGTGCTATGGATATTTATGCCGAAGCCGTCTATCGACTTGCAACTTAA TABLE 1-continued 4169.1 (SEQ. ID. NO. 287)
ATGTCTAATTCATTTGTCAAGTTGTTAGTCTCTCAATTATTTGCAAATTTAGCAGATATTTTCTTTAGAGTAACAAT
CATTGCTAACATATACATTATTTCAAAATCAGTAATTGCCACATCACTAGTTCCTATCTTAATAGGAATATCCTCTT
TTGTTGCGAGTCTTTTAGTTCCGTTGGTTACTAAAAGGTTAGCGCTAAATAGGGTTTTATCTTTATCTCAATTTGGA
AAGACTATATTATTGCGATACTGGTAGGAATGTTTACCGTAATGCAATCCGTAGCGCCTTTGGTGACCTATCTAT
TTGTTGTTGCAATTTCCATACTAGATGGTTTTGCAGCACCCGTTTCCTATGCTATTGTGCCACGCTATGCGACCGAT
TTGGGTAAGGCTAATTCAGCCTTATCAATGACTGGTGAAGCTGTTCAATTGATAGGTTGGGGATTAGGTGGACTCT
TGTTTGCAACAATTGGTCTGTTACCTACCACGTGTATCAATTTAGTCTTGTATATCATTTCTAGCTTTCTGATGTTA
TTTCTTCCTAACGCTGAAGTGGAGGTGTTAGAGTCAGAAACTAATCTTGAAATTTTGCTCAAAGGTTGGAAGTTAG
TTGCTAGAAATCCTAGATTAAGACTTTTTGTATCAGCAAATTTATTGGAAATTTTTTCAAATACGATTTGGGTTTCT
TCCATTATACTTGTTTTTGTAACGGAGTTATTAAATAAAACGGAAAGTTACTGGGGATATTCTAATACAGCATACT
CTATTGGTATTATAATTAGTGGCTTAATTGCTTTTAGGCTATCTGAAAAGTTCCTTGCTGCTAAATGGGAAGGGGA
ATTATTCACCCCAAATCTAAAAACCATCCAGAATCCTTGCCTTAGCTTAGATCCTGGATGGTTTCTTTTTTCACCCA
ATGGGTGTTTTTACTAGACAAAAAAGAGTTTCCCCTTTATGGTATAAGTGTAGAAAAAAACACAAAAAGAAAGG
AAACTCACATGAACAGTTTACCAAATCATCACTTCCAAAACAAGTCTTTTTACCAACTATCTTTCGATGGAGGTCA
TTTAACCCAGTATGGTGGTCTTATCTTTTTTCAGGAACTTTTTTCCCAGTTGAAACTAAAAGAGCGGATTTCTAAGT
ATTTAGTAACGAATGACCAACGCCGCTACTGTCGTTATTCGGATTCAGATATCCTTGTCCAGTTCCTCTTTCAACTG
TTAACAGGTTATGGAACGGACTATGCTTGTAAAGAATTGTCAGCTGATGCCTACTT
TCCAAAATTGTTGGAAGGAGGGCAGCTTGCTTCACAGCCAACCTTATCCCGTTTTCTTTCCAGAACTGACGAGGAA
ACAGTCCATAGTTTGCGATGCCTCAACCTTGAATTGGTCGAATTCTTTTTACAGTTTCACCAGCTAAACCAACTCA
TTGTAGATATCGATTCTACCCATTTCACAACTTATGGCAAGCAAGAAGGTGTTGCTTATAACGCCCACTATCGTGC
TCATGGCTATCATCCTCTTTATGCTTTCGAGGGGAAGACAGGTTATTGTTTCAATGCCCAGCTTCGTCCTGGTAATC
GTTATTGTTCTGAAGAGGCAGACAGCTTTATCACACCTGTTTAGAACGGTTTAATCAACTTCTCTTTCGAATGGA
TAGTGGCTTTGCGACCCCAAAATTATACGATTTAATTGAAAAAACAGGGCAATACTACCTCATAAAACTCAAGAA
AAATACTGTTCTGAGCCGTCTTGGAGACCTTTCCCTCCCTTGCCCACAGGATGAGGACTTAACCATCTTGCCCCAC
TCCGCCTACTCAGAAACTCTCTATCAAGCAGGATCTTGGTCGCACAAGCGTCGTGTCTGCCAGTTCTCTGAACGAA
AAGAAGGAAACTTGTTCTACGATGTTATTTCTCTCGTTACAAATATGACGAGTGGAACAAGCCAAGACAGTTTCA
GCTTTATCGTGGACGTGGTCAAGCCGAGAATTTCATCAAGGAGATGAAGGAGGGATTTTTTGGCGATAAAACGGA
TAGTTCAACCTTAATCAAAAACGAAGTTCGTATGATGATGAGCTGTATCGCCTACAATCTCTATCTTTTTCTCAAA
CATCTAGCTGGAGGTGACTTCCAAACTTTAACAATCAAACGCTTCCGCCATCTTTTTCTTCACGTGGTGGGAAAAT
GTGTTCGAACAGGACGCAAGCAGCTCCTCAAATTGTCTAGTCTCTATGCCTATTCCGAATTGTTTTCAGCACTTTA
TTCTAGGATTAGAAAAGTCAACCTGAATCTTCCTGTTCCTTATGAACCACCTAGAAGAAAAGCGTCGTTAATGATG
CATTAA 4169.3 (SEQ. ID. NO. 288)
ATGATGGAGTTTTTTCAACAGCTTCCTCATTTAGAGCCATATGGCAATCCTCAGTATTTTGTTTATGTGATTGCTGC
AACCTTGCCCATCTTTATAGGTCTCTTTTTCAAGAAACGCTTTGCCTGGTATGAAGTGTTGGTAAGTCTCTTCTTTA
TTGTCACCATGTTGGTGGGTGGAAAGACCAATCAACTAGCTGCCTTGGGTATTTACCTTTGCTGGGAAATATTGCT
CCTGCTTTTCTACAAGCATTATCGAAAAAGCAAGGATGGCAAGTGGGTCTTCTACTTAGTTAGTTTTCTGTCCCTA
CTTCCGATTATCTTTGTCAAGGTGCAACCAGCTATCAATGGAACGCAGTCTTTGCTGGTTCTTGGGAATTTCTTA
CCTGACCTTTCGTTCGGTTGGAATTGTCATCGAGCTGAGAGATGGAGTGATTAAGGATTTTACCCTCTGGGAATTC
CTCCGTTTCCTTCTCTTCATGCCAACTTTCTCGAGTGGTCCAATCGATCGCTTTAAGCGATTTAATGAAAATTATCA
GGCTATTCCTGAGCGAGATGAGTTGATGGATATGCTGGATGAATCTGTCCGCTATATCATGTGGGGCTTTTTGTAT
AAGTTTATCCTAGCTCATGTTTTAGGAGAGACCTTACTACCTCCTCTGAAGAATTTAGCCTTTGCAGTCAGGTGGCT
TCTTTAATCTCTATGCCTTGGCAGTTATGTATACTTTTGGTCTGGAACTCTTCTTTGACTTTGCAGGTTATTCTATGT
TTGCTTTGGCCATCTCAAACTTGATGGGAATCCGTAGCCCTATCAACTTTAACAAGCCCTTTTTATCAAGGGATTT
AAAGGAGTTTTGGAATCGCTGGCATATGAGTCTGTCCTTCTGGTTCCGTGACTTTGTCTTTATGCGAATGGTGATG
GTGTTAACCAGAAGAAAGTCTTTAAAAATCGTAATGTAACCTCAAGCTCACATTGTAAATATGCTGATTA
TGGGATTTTGGCATGGTGTGACCTGGTACTATATCGCCTATGGACTCTTTCATGGACTAGGCTTGGTCATCAATGA
TGCCTGGGTTCGCAAGAAAAAAACGCTCAATAAGGAACGGAAAAAAGCAGGGAAGGCTGCCCTACCTGAGAATC
GCTGGATTCAGTTGCTTGGCATGGTTGTCACTTTCCATGTTGTCATGTTGTCATTCTTAATCTTTTCTGGATTCTTGA
ATAATCTATGGTTTAAAAAATAA 4169.4 (SEQ. ID. NO. 289)
ATGCTTAAACGCTTATGGATGATCTTCGGACCGGTCTTGATCGCTGGTTTGTTGGTTTTTCTGCTCATTTTCTTTTAT
CCTACTGAGATGCATCATAATCTAGGAGCTGAAAAGCGTTCAGCAGTGGCTACTACTATCGATAGTTTTAAGGAGC
GAAGTCAAAAAGTCAGAGCACTATCTGATCCAAATGTGCGTTTTGTTCCCTTCTTTGGCTCTAGTGAATGGCTTCG
TTTTGACGGTGCTCATCCTGCGGTATTAGCTGAGAAATACAATCGTTCCTACCGTCCTTATCTTTTAGGACAGGGG
GGAGCTGCATCGCTTAACCAATATTTTGGAATGCAACAGATGTTACCACAGCTGGAGAATAAACAAGTTGTGTAT
GTTATCTCACCTCAGTGGTTCAGTAAAAATGGCTATGATCCAGCAGCCTTCCAGCAGTATTTTAATGGAGACCAGT
TGACTAGTTTTCTGAAACATCAATCTGGGGATCAGGCTAGTCAATATGCAGCGACTCGCTTACTGCAACAGTTCCC
AAACGTAGCTATGAAGGACCTGGTTCAGAAGTTGGCAAGTAAAGAAGAATTGTCGACAGCAGACAATGAAATGAT
TGAATTATTGGCTCGTTTAATGAACGCCAAGCTTCCTTTTTTGGTCAGTTTTCGGTTAGAGGCTATGTTAACTACG
ATAAGCATGTAGCTAAGTATTTAAAAATCTTGCCAGACCAGTTTTCTTATCAGGCAATAGAAGATGTTGTCAAAGC
AGATGCTGAAAAAATACTTCCAATAATGAGATGGGAATGGAAAATTATTTCTATAATGAGCAGATCAAGAAGGA
TTTGAAGAAATTAAAGGATTCTCAGAAAAGCTTTACCTATCTCAAGTCGCCAGAGTATAATGACTTGCAGTTGGTT
TTAACACAGTTTTCTAAATCTAAGGTAAACCCGATTTTTATCATTCCACCTGTTAATAAAAAATGGATGAACTATG
CTGGTCTACGAGAGGATATGTACCAACAAACGGTGCAGAAGATTCGCTACCAGTTAGAAAGTCAAGGTTTTACCA
ATATAGCAGATTTTTCTAAGGACGGCGGGAGCCTTTCTTTATGGAAGCACACCATTCACCTTGGTTGGTTGGGTTG
GTTGGCTTTTGACAAGGCAGTTGATCCTTTCCTATCCAATCCCACACCAGCTCCGACTTACCATCTGAATGAGCGC
TTTTTCAGCAAAGATTGGGCGACTTATGATGGAGATGTCAAAGAATTTCAATAG 4169.6 (SEQ. ID. NO. 290)
ATGGAGAAAAACCTCAAGGCTTTGAAACAAACAACAGACCAAGAAGGCCCAGCAATTGAACCTGAAAGGCAGA
GGATACCAAGACAGTCCAAAATGGTTACTTCGAGGATGCAGCTGTCAAGGACCGCACCTTGAGTGACTATGCAGG
TAACTGGCAATCAGTTTATCCTTTCCTTGAAGACGGCACGTTTGACCAAGTCTTTGACTACAAGGCTAAGTTGACT
GGTAAGATGACCCAGGCTGAGTACAAGGCTTACTATACAAAAGGCTATCATACAGATGTGACTAAGATTAACATT
ACTGATAATACTATGGAATTTGTTCAAGGTGGACAAAGCAAGAAATACACTTACAAGTATGTCGGTAAGAAAATT TABLE 1-continued TTGACTTACAAGAAAGGCAATCGTGGCGTGCGTTTCCTCTTTGAAGCCACAGATGCTGACGCTGGACAATTCAAGT
ATGTTCAGTTTAGTGACCACAATGTTGCCCCAGTTAAGGCAGAACATTTCCATATCTTCTTTGGAGGCACAAGCCA
AGAAGCCCTCTTTGAAGAAATGGACAACTGGCCAACCTACTACCCAGATAACCTATCTGGCCAAGAAATCGCCCA
AGAAATGTTGGCGCATTGA 4170.3                                                                       (SEQ. ID. NO. 291)
ATGAAAGATGGTCATTTGCTAGCCCATCATATTCGTTTGTTGAATGGGCGGATTTTTCAAAAGTTACTGAGTCAAG
ATCCTGAGGCTCTTTATAGGGGTGAACAGGGCAAGATTTTTAGCGGTTTTATGGAATAGTGAAACTGGCTGCGCAA
CTGCGACAGATATCGCGCTTGCGACTGGACTTGCGAATAATACGCTGACGACTATGATAAAAAAGCTAGAGGAAC
AAAAGCTTGTAATTGTTAGTCCGTGTGGAAAAGACAAGCGTAAGAAGTATTTAGTTTTAACGGAGTTAGGCAAGT
CCCAGAAAGAAGTGGGGCATCGTGTCAGTCAGAAATTGGATACTATCTTTTACAAAGGATTTTCAGAGGAAGAAA
TTCACCAATTTGAAGGTTTTCAAGAAAGAATTTTGGCGAATCTGAAAGAGAAGGGAAATGAGGTTTAG 4170.4                                                                       (SEQ. ID. NO. 292)
ATGACTAATTTAATTGCAACTTTTCAGGATCGTTTTAGTGATTGGTTGACAGCTCTATCTCAACATTTGCAGTTGTC
GCTTTTGACCTTGTTACTAGCTATTTTGCTTGCGATTCCCTTGGCTGTTTTTCTTCGCTATCATGAGAAGCTGGCCG
ACTGGGTCTTGCAGATTGCAGGTATTTTCCAGACCATCCCGTCTCTGGCCTTGTTGGGGCTCTTTATCCCTTTGATG
GGAATTGGGACCTTGCCGGCTTTGACAGCTCTAGTGATTTATGCGATTTTCCCTATTTTGCAAAATACTATCACTG
GGCTGAAGGGAATTGATCCGAACCTGCAAGAGGCTGGGATTGCCTTTGGGATGACCAGATGGGAACGTCTCAAGA
AATTTGAAATTCCACTCGCCATGCCTGTTATCATGTCTGGGATTCGGACGGCAGCTGTTTTGATTATCGGTACGGC
AACCTTGGCGGCCTTGATTGGTGCAGGGGGACTAGGTTCCTTTATTCTTTTGGGAATTGACCGTAATAATGCCAGT
TTGATTTTGATTGGGGCACTTTCTTCTGCAGTGCTAGCCATTGCCTTTAACTTCCTACTAAAAGTGATGGAAAAAG
CAAAATTACGGACGATTTTCTCAGGTTTTGCCTTGGTGGCTTTATTACTGGGTCTGTCTTATAGTCCAGCTCTTTTG
GTTCAAAAAGAGAAGGAAAACTTGGTTATTGCTGGGAAAATAGGTCCAGAACCAGAAGAATTTTGGCCAATATGTAT
AAGTTGCTGATTGAAGAAAATACCAGCATGACTGCGACTGTTAAACCGAATTTTGGGAAGACAAGCTTCCTTTATG
AAGCTCTGAAAAAAGGCGATATTGACATCTATCCTGAATTTACTGGTACGGTGACTGAAAGTTTGCTTCAACCATC
ACCCAAGGTGAGTCATGAACCAGAACAGGTTTATCAGGTGGCGCGTGATGGCATTGCTAAGCAGGATCATCTAGC
CTATCTCAAACCCATGTCTTATCAAAACACCTATGCTGTAGCTGTTCCGAAAAAGATTGCTCAAGAATATGGCTTG
AAGACCATTTCAGACTTGAAAAAGTGGAAGGGCAGTTGAAGGCAGGTTTTACAGCTGAGTTTAACGACCGTGAA
GATGGAAATAAGGGCTTGCAATCAATGTATGGTCTCAATCTCAATGTAGCGACCATTGAGCCAGCCCTTCGCTATC
AGGCTATTCAGTCAGGGGATATTCAAATCACGGATGCCTATTCGACTGATGCGGAATTGGAGCGTTATGATTTACA
GGTCTTGGAAGATGACAAGCAACTCTTCCCACCTTATCAAGGGGCTCCACTCATGAAAGAAGCTCTTCTCAAGAA
ACACCCAGAGTTGGAAAGAGTTCTTAATACATTGGCTGGTAAGATTACAGAAAGCCAGATGAGCCAGCTCAACTA
CCAAGTCGGTGTTGAAGGCAAGTCAGCAAAGCAAGTAGCCAAGGAGTTTCTCCAAGAACAAGGTTTGTTGAAGAA
ATGA 4170.5                                                                       (SEQ. ID. NO. 293)
ATGATGCATACTTATTTGCAAAAGAAAATTGAAAATATCAAAACAACCCTAGGTGAAATGTCAGGTGGTTACCGT
CGTATGGTTGCGGCTATGGCTGATTTAGGATTTTCAGGAACTATGAAGGCTATCTGGGATGACCTCTTTGCCCATC
GTAGTTTTGCCCAGTGGATTTATTTGCTGGTTTTAGGAAGTTTTCCTCTCTGGCTGGAGTTGGTTTACGAACATCGT
ATTGTTGACTGGATTGGGATGATTTGTAGCTTGACAGGGATTATCATCATCATCGGTAGATGTCTGTATCGGAAGGTCGAGCAA
GTAATTATCTTTTTGGCTTGATTAACTCTGTTATTTACCTTATTTTGGCCCTACAGAAAGGCTTTTATGGTGAGGTG
CTGACGACACTTTACTTCACAGTCATGCAGCCAATTGGACTTCTAGTTTGGATTTATCAGGCACAGTTTAAGAAGG
AAAAGCAGGAGTTTGTCGCGCGCTAAACTGGACGGCAAGGGCTGGACAAAGTATCTTTCCATTAGTGTGCTTTGGT
GGTTGGCCTTTGGCTTCATTTATCAGTCTATTGGTGCCAATCGTCCCTATGCTGTGATTCAATCACAGATGCAACCAA
TGGGGTAGGGCAAATCCTCATGACAGCTGTTTACCGTGAACAGTGGATATTCTGGGCGGCTACCAATGTCTTTTCA
ATCTATCTCTGGTGGGGAGAAAGCCTGCAAATTCAAGGGAAATATCTAATTTATCTCATTAACAGTCTAGTTGGTT
GGTATCAATGGAGCAAGGCAGCTAAGCAGAATACTGATTTACTTAACTAG 4170.6                                                                       (SEQ. ID. NO. 294)
ATGAGAAATATGAAGGCAAAATATGCTGTTTGGGTGGCTTTTTTCTTAAATTTGACTTATGCCATTGTTGAGTTTA
TGCAGGTGGAGTATTTGGTTCTAGCGCTGTTCTTGCTGACTCTGTGCATGACTTGGGAGATGCGATTGCAATTGGA
ATATCAGCTTTTCTAGAAACAATCTCCAATCGTGAAGAAGACAATCAGTACACCTTGGGCTATAAGCGGTTAGCC
TGCTAGGAGCCTTGGTAACAGCTGTGATTCTCGTAACGGGCTCTGTTCTAGTCATTTTGGAAAATGTCACGAAGAT
TTGCATCCGCAACCAGTCAATGATGAGGGGATTCTCTGGTTAGGAATTATTGCGATTACTATCAATCTGTTAGCG
AGTCTGGTGGTTGGTAAGGGAAAGACAAAGAATGAGTCTATTCTGAGTCTGCATTTTCTGGAAGATACGCTAGGG
TGGGTAGCTGTTATCCTGATGGCGATTGTTCTTCGATTTACGGACTGGTATATCCTAGATCCTCTTTTGTCCCTTGT
CATTTCTTTCTTTATTCTTTCAAAAGCCCTTCCACGTTTTTGGTCTACACTCAAGATTTTCTTGGATGCTGTGCCAG
AAGGTCTTGATATCAAGCAAGTAAAGAGTGGCCTGGAGCGATTGGACAATGTGGCCAGCCTTAATCAGCTTAATC
TCTGGACTATGGATGCTTTGGAAAAAAATGCCATTGTCCATGTTTGTCTAAAAGAAATGGAACATATGGAACTTG
TAAAGAGTCTATTCGAATTTTCCTAAAAGATTGTGGTTTTCAAAATATTACCATTGAAATTGATGCTGACCTAGAA
ACTCACCAAACCCATAAGCGAAAGGTGTGTGACTTGGAACGGAGTTATGAGCATCAACATTAG 4170.8                                                                       (SEQ. ID. NO. 295)
ATGATTGAATACAAAAATGTAGCACTGCGCTACACAGAAAAGGATGTCTTGAGAGATGTCAACTTACAGATTGAG
GATGGGGAATTTATGGTTTTAGTAGGGCCTTCTGGGTCAGGTAAGGACGACCATGCTCAAGATGATTAACCGTCTTT
TGGAACCAACTGATGGAAATATTTATATGGATGGGAAGCGCATCAAAGACTATGATGAGCGTGAACTTCGTCTTT
CTACTGGTTATGTTTTACAGGCTATTGCTCTTTTTCCAAATCTAACAGTTGCGGAAAATATTGCTCTCATTCCTGAA
ATGAAGGGGTGGAGCAAGGAAGAAATTACGAAGAAAACAGAAGAGCTTTTGGCTAAGGTTGGTTTACCAGTAGCC
GAGTATGGGCATCGCTTACCTAGTGAATTATCTGGTGGAGAACAGCAACGGGTCGGTATTGTCCGAGCTATGATTG
GTCAGCCCAAGATTTTCCTCATGGATGAACCCTTTTCGGCCTTGGATGCTATTTCGAGAAAACAGTTGCAGGTTCT
GACAAAAGAATTGCATAAAGAGTTTGGGATGACAACGATTTTTGTAACCCATGATCGGATGAAGCCTTGAAGTT
GGCGGACCGTATTGCTGTCTTGCAGGATGGAGAAATTCGCCAGGTAGCGAATCCCGAGACAATTTTAAAAGCGCC
TGCAACAGACTTTGTAGCAGACTTGTTTGGAGGTAGTGTTCATGACTAA 4171.1                                                                       (SEQ. ID. NO. 296)
ATGTCAGCAGTTGCTATTTCAGCTATGACCAAGGTTATGCAAGAAACCCACGGAAATCCTTCTAGTATTCATGGTC
ATGGTCGTCAAGCTGGCAAACTCTTGCGAGAAGCCCGTCAGGAACTAGCCCAGTTACTAAGGACAAAACCTCAAC
ATATCTTTTTCACTTCTGGTGGGACTGAAGGCAATAATACTACCATCATTGGCTACTGTCTTCGTCACCAAGAACA TABLE 1-continued AGGAAAACATATCATCACAACTGCCATCGAGCACCATGCTGTCCTTGAAACAATTGATTACTTGGTTCAACACTTT
GGGTTTGAAGCAACCATTATCCAGCCAGAAATCAAGAAATCACAGCCCAGCAAATTCAAAAGGCTTTACGTGAC
GATACGATTTTGGTTTCTACCATGTTTGTCAATAATGAGACAGGAAACCTACTGCCCATCGCTGAAATTGGCCAAA
TACTCAAGCAACACCCTGCTGCCTATCATGTTGATGCAGTTCAGGCTATTGGTAAAATCCCAATTCATTCAGAAGA
ATTGGGCATTGATTTTCTCACTGCTTCTGCCCACAAATTCCATGGTCCTAAGGGAATCGGTTTTCTCTACGCATCTA
GCATGGACTTTGATTCCTATCTACATGGCGGAGACCAGGAACAGAAAAAACGTGCAGGAACTGAAAATCTGCCTG
CCATTGTAGGCATGGTTGCAGCCCTAAAAGAAGACCTAGAAAAACAAGAAGAACATTTTCAACATGTACAAAATC
TAGAAACTGCCTTTCTGGCAGAGCTGGAGGGCATTCAGTATTACCTGAATAGAGGAAAACATCATCTCCCTTATGT
TCTCAATATTGGATTTCCTGGTCAGAAAAATGACCTCTTACTCCTTCGGCTAGATTTAGCTGGAATTTCAATCTCTA
CTGGCTCAGCCTGTACTGCAGGCGTTGTCCAATCCAGCCATGTTCTTGAAGCCATGTATGGCGCAAATTCAGAACG
CTTGAAGGAATCCCTTCGCATCAGTTTGTCGCCACAAAATACCGTTGAAGACCTACAAACCCTCGCAAAAACCTTA
AAAGAAATTATCGGAGGTTAG 4172.1 (SEQ. ID. NO. 297)
ATGTTATTCAAATTATCTAAGGAAAAAATAGAGCTAGGCTTATCTCGTTTATCGCCAGCCCGTCGTATTTTTTTGA
GTTTTGCCTTGGTCATTTTACTAGGCTCTCTTCTTTTGAGCTTGCCCTTTGTCCAAGTTGAAAGCTCACGAGCGACT
TATTTTGATCATCTTTTCACTGCTGTCTCTGCAGTCTGTGTGACGGGTCTCTCAACCCTTCCAGTAGCTCACACCTA
TAATATCTGGGGTCAAATAATCTGTTTGCTCTTGATTCAGATCGGTGGTCTAGGGCTCATGACCTTTATTGGGGTTT
TCTATATCCAGAGCAAGCAAAAGCTTAGTCTTCGTAGCCGTGCAACTATTCAGGATAGTTTTAGTTATGGAGAAAC
TCGATCTTTGAGAAAGTTTGTCTATTCTATTTTTCTCACGACCTTTTTGGTTGGAGAGCTTGGGAGCTATTTTGCTTA
GTTTTCGCCTTATTCCTCAACTTGGCTGGGGACGTGGTCTTTTTAGTTCCATTTTTCTAGCGATCTCAGCCTTCTGT
AATGCCGGTTTTGATAATTTAGGGAGCACCAGTTTATTTGCTTTTCAGACCGATTTACTGGTCAATCTGGTGATTGC
AGGCTTGATTATTACAGGCGGCCTTGGTTTTATGGTCTGGTTTGATTTGGCTGGTCATGTAGGAAGAAAGAAAAAA
GGACGTCTGCACTTTCATACGAAGCTTGTACTATTATTGACTATAGGTTTGTTGTTATTTGGAACAGCAACTACTCT
CTTTCTTGAGTGGAACAATGCTGGAACGATTGGCAATCTCCCTGTTGCCGATAAGGTTTTAGTTAGCTTTTTTCAA
ACAGTGACGATGCGAACAGCTGGCTTTTCTACGATAGATTATACTCAGGCTGTCATCCTGTGACTCTTTTGATTTATA
TCTTACAGATGTTTCTAGGTGGGGCACCTGGAGGAACAGCTGGGGGACTCAAGATTACGACATTTTTTGTCCTCTT
GGTCTTTGCACGAAGTGAGCTTCTAGGCTTGCCTCATGCCAATGTTGCGAGACGAACGATCGCGCCGCGAACGGTT
CAAAAATCCTTTAGTGTCTTTATTATCTTTTTGATGAGCTTCTTGATAGGATTGATTCTGCTAGGGATAACAGCCAA
AGGCAATCCTCCCTTTATCCACCTCGTATTTGAAACCATTTCAGCTCTTAGTACAGTTGGTGTAACGGCAAATCTG
ACTCCTGACCTTGGGAAATTGGCTCTCAGTGTTATCATGCCACTTATGTTTATGGG
ACGAATTGGTCCCTTGACCTTGTTTGTTAGCTTGGCAGATTACCATCCAGAAAAGAAAGATATGATTCACTATATG
AAAGCAGATATTAGTATTGGTTAA 4172.2 (SEQ. ID. NO. 298)
ATGTCAGATCGTACGATTGGAATTTTGGGCTTGGGAATTTTTGGGAGCAGTGTCCTAGCTGCCCTAGCCAAGCAGG
ATATGAATATTATCGCTATTGATGACCACGCAGAGCGCATCAATGATTTGAGCCAGTTTTGGCGCGTGGAGTGAT
TGGTGACATCACAGATGAAGAATTATTGAGATCAGCAGGGATTGATACCTGCGATACCGTTGTAGTCGCGACAGG
TGAAAATCTGGAGTCGAGTGTGCTTGCGGTTATGCACTGTAAGAGTTTGGGGGTACCGACTGTTATTGCTAAGGTC
AAAAGTCAGACCGCTAAGAAAAGTGCTAGAAAAGATTGGAGCTGACTCGGTTATCTCGCCAGAGTATGAAATGGGG
CAGTCTCTAGCACAGACCATTCTTTTCCATAATAGTGTTGATGTCTTCAGTTGGATAAAAATGTGTCTATCGTGG
AGATGAAAATTCCTCAGTCTTGGGCAGGTCAAAGTCTGAGTAAATTAGACCTCCGTGGCAAATACAATCGTGAATA
TTTTGGGTTTCCGAGAGCAGGAAAATTCCCCATTGGATGTTGAATTTGGACCAGATGACCTCTTGAAAGCAGATAC
CTATATTTTGGCAGTCATCAACAACCAGTATTTGGATACCCTAGTAGCATTGAATTCGTAA 4172.3 (SEQ. ID. NO. 299)
ATGAAGTTATTGTCTATCGCAATTTCTAGCTATAATGCAGCAGCCTATCTTCATTACTGTGTGGAGTCGCTAGTGA
TTGGTGGTGAGCAAGTTGGGATTTTGATTATCAATGACGGGTCTCAGGATCAGACTCAGGAAATCGCTGAGTGTTT
AGCTAGCAAGTATCCTAATATCGTTAGAGCCATCTATCAGGAAAATAAATGCCATGGCGTGCGGTCAATCGTGG
CTTGGTAGAGGCTTCTGGGCGCTATTTTAAAGTAGTTGACAGTGATGACTGGGTGGATCCTCGTGCCTACTTGAAA
ATTCTTGAAACCTTGCAGGAACTTGAGAGCAAAGGTCAAGAGGTGGATGTCTTTGTGACCAATTTTGTCTATGAAA
AGGAAGGGCAGTCTCGTAAGAAGAGTATGAGTTACGATTCAGTCTTGCCTGTTCGGCAGATTTTTGGCTGGGACCA
GGTCGGAAATTTCTCCAAAGGCCAGTATACCATGATGCACTCGCTGATTATCGGACAGATTTGTTGCGTGCTAGC
CAGTTCTAA 4172.4 (SEQ. ID. NO. 300)
ATGAAATTCAATCCAAATCAAAGATATACTCGTTGGTCTATTCGCCGTCTCAGTGTCGGTGTTGCCTCAGTTGTTG
TGGCTAGTGGCTTCTTTGTCCTAGTTGGTCAGCCAAGTTCTGTACGTCCGATGGCTCAATCCAACCCCAGGTCA
AGTCTTACCTGAAGAGACATCGGGAACGAAAGAGGGTGACTTATCAGAAAAACCAGGAGACACCGTTCTCACTCA
AGCGAAACCTGAGGGCGTTACTGGAAATACGAATTCACTTCCGACACCTACAGAAAGAACTGAAGTGAGCGAGGA
AACAAGCCCTTCTAGTCTGGATACACTTTTTGAAAAAGATGAAGAAGCTCAAAAAAATCCAGAGCTAACAGATGT
CTTAAAAGAAACTGTAGATACACTGATGTGGATGGGACACAAGCAAGTCCAGCAGAAACTACTCCTGAACAAGT
AAAAGGTGGAGTGAAAGAAAATACAAAAGACAGCATCGATGTTCCTGCTGCTTATCTTGAAAAAGCTGAAGGGAA
AGGTCCTTTCACTGCCGGTGTAAACCAAGTAATTCCTTATGAACTATTCGCTGGTGATGGTATGTTAACTCGTCTA
TTACTAAAAGCTTCGGATAATGCTCCTTGGTCTGACAATGGTACTGCTAAAAATCCTGCTTTACCTCCTCTTGAAG
GATTAACAAAAGGGAAATACTTCTATGAAGTAGACTTAAATGGCAATACTGTTGGTAAACAAGGTCAAGCTTTAA
TTGATCAACTTCGCGCTAATGGTACTCAAACTTATAAAGCTACTGTTAAAGTTTACGGAAATAAAGACGGTAAAGC
TGACTTGACTAATCTAGTTGCTACTAAAAATGTAGCATCAACATCAATGGATTAGTTGCTAAAGAAACAGTTCAA
AAAGCCGTTGCAGACAACGTTAAAGACAGTATCGATGTTCCAGCAGCCTACCTAGAAAAAGCCAAGGGTGAAGGT
CCATTCACAGCAGGTGTCAACCATGTGATTCCATACGAACTCTTCGCAGGTGATGGTATGTTGACTCGTCT
CTTGCTCAAGGCATCTGACAAGGCACCATGGTCAGATAACGGTGACGCTAAAAACCCAGCCCTATCTCCACTAGG
TGAAAACGTGAAGACCAAAGGTCAATACTTCTATCAATTAGCCTTGGACGGAAATGTAGCTGGCAAAGAAAACA
AGCGCTCATTGACCAGTTCCGAGCAAACGGTACTCAAACTTACAGCGCTACAGTCAATGTCTATGGTAACAAAGA TABLE 1-continued CGGTAAACCAGACTTGGACAACATCGTAGCAACTAAAAAAGTCACTATTAACATAAACGGTTTAATTTCTAAAGA
AACAGTTCAAAAAGCCGTTGCAGACAACGTTAAGACAGTATCGATGTTCCAGCAGCCTACCTAG 4172.5 (SEQ. ID. NO. 301)
ATGAAACTAAAAAGTTATATTTTGGTTGGATATATTATTTCAACCCTCTTAACCATTTTGGTTGTTTTTGGGCTGT
TCAAAAAATGCTGATTGCGAAAGGCGAGATTTACTTTTTGCTTGGGATGACCATCGTTGCCAGCCTTGTCGGTGCT
GGGATTAGTCTCTTTCTCCTATTGCCAGTCTTTACGTCGTTGGGCAAACTCAAGGAGCATGCCAAGCGGGTAGCGG
CCAAGGATTTTCCTTCAAATTTGGAGGTTCAAGGTCCTGTAGAATTTCAGCAATTAGGGCAAACTTTTAATGAGAT
GTCCCATGATTTGCAGGTAAGCTTTGATTCCTTGGAAGAAAGCGAACGAGAAAAGGGCTTGATGATTGCCCAGTT
GTCGCATGATATTAAGACTCCTATCACTTCGATCCAAGCGACGGTAGAAGGGATTTTGGATGGGATTATCAAGGA
GTCGGAGCAAGCTCATTATCTAGCAACCATTGGACGCCAGACGGAGAGGCTCAATAAACTGGTTGAGGAGTTGAA
TTTTTTGACCCTAAACACAGCTAGAAATCAGGTGGAAACTACCAGTAAAGACAGTATTTTTCTGGACAAGCTCTTA
ATTGAGTGCATGAGTGAATTTCAGTTTTTGATTGAGCAGGAGAGAAGAGATGTCCACTTGCAGGTAATCCCAGAGT
CTGCCCGGATTGAGGGAGATTATGCTAAGCTTTCTCGTATCTTGGTGAATCTGGTCGATAACGCTTTTAAATATTC
TGCTCCAGGAACCAAGCTGGAAGTGGTGGCTAAGCTGGAGAAGGACCAGCTTTCAATCAGTGTGACCGATGAAGG
GCAGGGTATTGCCCCAGAGGATTTGGAAAATATTTTCAAACGCCTTTATCGTGTCGAAACTTCGCGTAACATGAAG
ACAGGTGGTCATGGATTAGGACTTGCGATTGCGCGTGAATTGGCCCATCAATTGGGTGGGGAAATCACAGTCAGC
AGCCAGTACGGTCTAGGAAGTACCTTTACCCTCGTTCTCAACCTCTCTGGTAGTGAAAATAAAGCCTAA 4172.6 (SEQ. ID. NO. 302)
ATGTTTGGTCAAACGGCTCAACATGGTCTTACGAATAGCCTGAAAGACTTCTGGATTTTTCTGCTGAATATAGGTC
CACAATTGGCGTTTTTTTGCCAGATGCTCCGCTGTTCCAGATCGGTTGAGCAGGGTACTGGAAATCACCGTCGTGA
GTTCAATATGATTCAGCAGATATTCTCGCATTTTGGGATGACTCACTTGGGACAAATCAAGTTGGTCTATCAAGAG
TCGATTGACCTTGAGTTGCTGGTCAATGCACTTAATCATCACTTGCTCATTGACAGACTGGTCCTCACGCCCAATC
AAATAACGATAGAAATCGACAGGCAGATAGTACATGGTCTTGACCTGCTGAAGGGGCGTAAAGACAAAGAGATTA
TCGACATAAAAAGTATGTTCAGGCAGTTAGAACTGGCTAGCACGCAACAAATCTGTCCGATAAATCAGCGAGTGC
ATCATGGTATACTGGCCTTTGGAGAAATTTCCGACCTGGTCCCAGCCAAAAATCTGCCGAACAGGCAAGACTGA 4174.1 (SEQ. ID. NO. 303)
ATGGAACATTTAGCAACTTATTTTTCAACCTATGGAGGAGCTTTCTTCGCTGCATTGGGAATTGTATTGGCGGTTG
GATTAAGCGGTATGGGGTCTGCTTATGGAGTTGGTAAGGCTGGGCAATCTGCCGCAGCTTTACTGAAAGAACAGC
CTGAAAAGTTTGCCTCAGCTTTGATATTGCAATTATTGCCCGGAACACAAGGATTATATGGTTTTGTTATTGGAAT
TTTAATTTGGTTGCAATTAACTCCAGAACTTCCTTTAGAAAAAGGCGTTGCTTATTTCTTTGTAGCTCTTCCAATTG
CTATTGTAGGATACTTTTCAGCTAAGCATCAAGGAAATGTAGCAGTAGCGGGAATGCAAATCTTGGCTAAAAGAC
CAAAAGAATTCATGAAGGGAGCAATTTTAGCTGCCATGGTAGAAACCTATGCAATTCTTGCTTTTGTCGTATCATT
CATTTTTGACCCTTCGTGTATTA 4175.2 (SEQ. ID. NO. 304)
ATGTTAAAATCAGAAAAACAATCACGTTATCAAATGTTAAATGAAGAATTGTCCTTCCTATTGGAAGGCGAAACC
AATGTTTTGGCTAATCTTTCCAACGCCAGTGCTCTCATAAAATCACGTTTTCCTAATACCGTATTTGCAGGCTTTTA
TTTGTTCGATGGAAAGGAATTGGTTTTAGGCCCCTTCCAAGGAGGTGTTTCCTGCATCCGTATTGCACTAGGCAAG
GGTGTTTGTGGTGAGGCAGCTCACTTTCAGGAAACTGTTATTGTTGGAGATGTGACGACCTATCTCAACTATATTT
CTTGTGATAGTCTAGCTAAAAGTGAAATTGTGGTGCCGATGATGAAGAATGGTCAGTTACTTGGAGTTCTGGATCT
GGATTCTTCAGAGATTGAGGATTACGATGCTATGGATCGAGATTATTTGGAACAATTTGTCGCTATTTTGCTTGAA
AAGACAGCATGGGACTTTACGATGTTTGAGGAAAAATCTTAA 4175.3 (SEQ. ID. NO. 305)
ATGTCAGTATTAGAGATCAAAGATCTTCACGTTGAGATTGAAGGAAAAGAAATTTTAAAAGGGGTTAACCTGACC
CTGAAAACAGGAGAAATTGCCGCTATCATGGGACCAAATGGTACAGGTAAATCGACTCTTTCTGCCGCTATCATG
GGAAATCCAAACTATGAAGTAACTAAAGGTGAAGTTTTGTTTGATGGCGTAAACATCCTTGAGTTGGAAGTGGAT
GAGCGTGCGCGTATGGGACTTTTCCTTGCTATGCAATACCCATCAGAAATCCCTGGAATTACCAATGCTGAGTTTC
TTCGTGCCGCTATGAATGCGGGTAAAGAAGATGATGAGAAGATTTCAGTTCGTGAGTTTATTACTAAGCTAGATGA
AAAAATGGAATTGCTCAACATGAAAGAAGAAATGGCAGAGCGTTACCTCAACGAAGGCTTCTCTGGTGGTGAGAA
AAAACGCAATGAAATTCTTCAACTTTTTGATGTTGGAGCCAACATTTGCTCTTTTGGACGAGATTGACTCAGGTCTT
GATATTGACGCTCTTAAAGTTGTGTCTAAAGGTGTCAATGCCATGCGTGGTGAAGGTTTTGGTCGTATGATCATCA
CTCACTACCAACGTCTTTTGAACTATATCACACCTGATGTGGTCACGTGATGATGGAAGGTCGTGTTGTCCTTTC
TGGTGGTCCAGAATTGGCTGCGCGTTTGGAACGTGAAGGATACGCAAAATTAGCTGAAGAACTTGGCTACGACTA
CAAGGAAGAATTGTAA 4174.4 (SEQ. ID. NO. 306)
ATGCCCTACAAAAGACAAAGGAGTTTTTCAATGGCACTTTCTAAACTAGATAGCCTTTATATGGCAGTGGTAGCAG
ACCATTCGAAAAATCCACATCACCAAGGGAAGTTAGAAGATGCTGAGCAAATCAGTCTCAACAATCCGACTTGTG
GGGATGTCATCAACCTCTCTGTCAAGTTTGATGCAGAGGACCGTTTGGAAGATATTGCTTTTCTAAATTCAGGATG
CACGATTTCAACTGCTTCTGCTAGTATGATGACAGATGCCGTTTTAGGAAAAACCAAACAAGAAATTTTAGAACTG
GCGACTATTTTTTCTGAAATGGTTCAAGGGCAAAAAGATGAGCGTCAAGACCAACTTGGAGACGCGGCATTCTTG
TCAGGTGTTGCCAAATTCCCTCAAAGAATCAAGTGTGCAACCCTAGCTTGGAATGCCCTTAAGAAAACAATTGAA
AATCAAGAAAAACAGTAA 4175.5 (SEQ. ID. NO. 307)
ATGAAAATTCAAGACCTATTGAGAAAAGATGTCATGTTGCTAGATTTGCAGGCAACTGAAAAAACAGCTGTCATC
GACGAGATGATTAAAAATTTGACAGACCACGGTTATGTAACAGATTTTGAAACATTTAAAGAAGGAATTTTGGCG
CGTGAAGCTTTGACTTCTACTGGTTTGGGTGATGGAATCGCAATGCCTCACAGCAAAAACGCTGCTGTCAAAGAA
GCGACAGTTCTATTTGCTAAGTCAAATAAGGGTGTTGACTACGAGAGCTTGGATGGACAAGCAACTGACCTCTTCT
TCATGATTGCAGCTCCAGAAGGTGCCAATGATACTCACTTGGCAGTTGCTGGCAGAATTGTCTCAATACTTGATGAA
AGACGGTTTTGCAGACAAACTTCGTCAAGCAACATCTGCAGACCAAGTTATCGAACTTTTTGACCAAGCTTCAGAA
AAAACTGAGGAACTTGTTCAAGCACCTGCTAATGACTCTGGTGACTTTATCGTAGCTGTTACAGCTTGTACAACAG
GTATTGCCCACACTTACATGGCCCAAGAAGCCCTTCAAAAAGTAGCTGCTGAAATGGGGGTTGGTATCAAGGTCG
AAACCAACGGTGCTAGCGGTGTTGAAATCAACTAACTGCAGAAGATATCCGTAAGGCTAAAGCTATTATCATTG
CAGCAGACAAGGCCGTTGAAATGGATCGATTTGATGGAAAACCATTGATCCATCGTCCAGTTGCTGACGTATCC TABLE 1-continued

```
GTAAGACAGAAGAGCTAATTAACTTGGCTCTTTCAGGAGATACTGAAGTCTACCGTGCCGCTAATGGTGCCAAAG
CTGCAACAGCCTCTAACGAAAAACAAAGCCTTGGTGGTGCCTTGACAAACACTTGATGAGTGGTGTATCTCAAA
TGTTACCATTCGTTATCGGTGGTGGTATCATGATTGCCCTTGCCTCTTGATTGACGGTGCTTTGGGTGTTCCAAAT
GAAAACCTTGGCAATCTTGGTTCTTACCATGAGTTAGCTTCTATGTTCATGAAAATTGGTGGAGCTGCTTTGGTTT
GATGCTTCCAGTCTTTGCGGGTTATGTTGCCTACTCTATTGTGAAAAACCGGGTTTGGTAGCAGGTTTCGTGGCT
GGTGCTATTGCCAAAGAAGGTTTTGCCTTTGGTAAAATTCCTTATGCCGCAGGTGGTGAAGCAACTTCAACTCTTG
CAGGTGTCTCATCTGGTTTCCTAGGTGCCCTTGTTGGTGGATTTATCGCAGGTGCCTTGGTTCTTGCCATCAGAAA
TACGTTAAAGTTCCTCGTTCACTCGAAGGTGCTAAATCAATCCTTCTATTGCCACTTCTTGGAACAATCTTGACAG
GATTTGTTATGCTAGCTGTGAATATCCCAATGGCTGCAATCAACACTGCTATGAATGACTTCCTAGGCGGTCTTGG
AGGAGGTTCAGCTGTCCTTCTTGGTATCGTCCTTGGTGGAATGATGGCTGTTGACATGGGTGGACCAGTTAATAAA
GCAGCTTATGTCTTTGGTACAGGTACGCTTGCAGCAACTGTTTCTTCAGGTGGTTCTGTAGCCATGGCAGCAGTTA
TGGCTGGAGGAATGGTGCCACCACTTGCAATCTTTGTCGCAACTCTTCTTTTCAAAGATAAATTTACTAAGGAAGA
ACGTAACTCTGGTTTGACAAACATCATCATGGGCTTGTCATTTATCACTGAGGGAGCGATTCCATTTGGTGCCGCT
GACCCAGCTCGTGCGATTCCAAGCTTCATCCTTGGTTCAGCAGTAGCAGGTGGACTCGTTGGTCTTACTGGTATCA
AACTCATGGCGCCACACGGAGGAATCTTCGTTATCGCCCTTACTTCAAATGCTCTCCTTTACCTCGTTTCTGTCTTG
GTAGGAGCAATCGTAAGTGGTGTGGTTTATGGTTACCTACGCAAACCACAAGCATAA 4175.6                                                      (SEQ. ID. NO. 308)
ATGGCAAACAAGAATACAAGTACAACAAGACGGAGACCGTCTAAAGCAGAACTGGAAAGAAAAGAAGCGATTCA
ACGAATGTTGATTTCGTTAGGAATTGCGATTTTATTGATTTTCGCAGCCTTCAAATTAGGGCTGCAGGTATAACC
CTTTATAATTTAATTCGCTTGCTAGTGGGTAGCCTAGCTTATCTGGCGATATTCGGCCTATTAATCTATCTCTTCTT
TTTCAAGTGGATACGAAAACAGGAAGGACTCTTATCTGGCTTTTTCACCATATTTGCTGGCTTACTCTTGATTTTTG
AGGCCTACTTGGTTTGGAAATATGGTTTGGACAAGTCCGTTCTAAAAGGGACCATGGCTCAGGTTGTGACAGATCT
GACTGGTTTTCGAACGACTAGCTTTGCTGGAGGGGGCTTGATCGGATTCGTGCTCTTTATATTCCACAGCCTTTCTC
TTTTCAAATATCGGAACTTACTTTATTGGTTCTATCTTGATTTTAGTGGGTTCTCTCCTAGTCAGCCCTTGGTCTGTT
TACGATATTGCTGAATTTTTCAGTAGAGGCTTTGCCAAATGGTGGGAAGGGCACGAGCGTCGAAAAGAGGAACGC
TTTGTCAAACAAGAAGAAAAAGCTCGCCAAAAGGCTGAGAAAGAGGCTAGATTAGAACAAGAAGAGACTGAAAA
AGCCTTACTCGATTTGCCTCCTGTTGATATGGAAACGGGTGAAATTCTGACAGAGGAAGCTGTTCAAAATCTTCCA
CCTATTCCAGAAGAAAAGTGGGTGGAACCAGAAATCATCCTGCCTCAAGCTGAACTTAAATTCCCTGAACAGGAA
GATGACTCAGATGACGAAGATGTTCAGGTCGATTTTTCAGCCAAAGAAGCCCTTGAATACAAACTTCCAAGCTTA
CAACTCTTTGCACCAGATAAACCAAAAGATCAGTCTAAAGAGAAGAAAATTGTCAGAGAAAATATCAAAATCTTA
GAAGCAACCTTTGCTAGCTTTGGTATTAAGGTAACAGTTGAACGGGCCGAAATTGGGCCATCAGTGACCAAGTAT
GAAGTCAAGCCGGCTGTTGGTGTAAGGGTCAACCGCATTTCCAATCTATCAGATGACCTCGCTCTAGCCTTGGCTG
CCAAAGATGTCCGGATTGAAGCACCAATCCCTGGGAAATCCTAATCGGAATTGAAGTGCCCAACTCCGATATTG
CCACTGTATCTTTCCGAGAACTATGGGAACAATCGCAAACGAAAGCAGAAATTCTTGGAAATTCCTTTAGGGA
AGGCTGTTAATGGAACCGCAAGAGCTTTTGACCTTTCTAAAATGCCCCACTTGCTAGTTGCAGGTTCAACGGGTTC
AGGGAAGTCAGTAGCAGTTAACGGCATTATTGCTAGCATTCTCATGAAGGCGAGACCAGATCAAGTTAAATTTAT
GATGGTCGATCCCAAGATGGTTGAGTTATCTGTTTACAATGATATTCCCCACCTCTTGATTCCAGTCGTGACCAAT
CCACGCAAAGCCAGCAAGGCTCTGCAAAAGGTTGTGGATGAAATGGAAAACCGTTATGAACTCTTTGCCAAGGTG
GGAGTTCGGAATATTGCAGGTTTTAATGCCAAGGTAGAAGAGTTCAATTCCCAGTCTGAGTACAAGCAAATTCCG
CTACCATTCATTGTCGATTGTGGATGAGTTGGCTGACCTCATGATGGTGGCCAGCAAGGAAGTGGAAGATGCTA
TCATCCGTCTTGGGCAGAAGGCGCGTGCTGCAGGTATCCACATGATTCTTGCAACTCAGCGTCCATCTGTTGATGT
CATCTCTGGTTTGATTAAGGCCAATGTTCCATCTCGTGTAGCATTTGCGGTTTCATCAGGAACAGACTCCCGTACG
ATTTTGGATGAAAATGGAGCAGAAAAACTTCTTGGTCGAGGAGACATGCTCTTTAAACCGATTGATGAAAATCAT
CCAGTTCGTCTCCAAGGCTCCTTTATCTCGGATGACGATGTTGAGCGCATTGTGAACTTCATCAAGACTCAGCAG
ATGCAGACTACGATGAGAGTTTTGATCCAGGTGAGGTTTCTGAAAATGAAGGAGAATTTTCGGATGGAGATGCTG
GTGGTGATCCGCTTTTTGAAGAAGCTAAGTCTTTGGTTATCGAAACACAGAAAGCCAGTGCGTCTATGATTCAGCG
TCGTTTATCAGTTGGATTTAACCGTGCGCACCCGTCTCATGGAAGAACTGGAGATAGCAGGTGTCATCGGTCCAGCT
GAAGGTACCAAACCTCGAAAAGTGTTACAACAATAA 4176.1                                                      (SEQ. ID. NO. 309)
ATGAGTTATTTTAAAAAATATAAATTCGATAAATCCCAGTTCAAACTTGGTATGCGAACCTTTAAAACAGGTATTG
CTGTTTTTCTAGTTCTCTTGATTTTTGGCTTTTTTGGCTGGAAAGGTCTTCAAATTGGTGCTTTGACAGCCGTTTTTA
GCCTGAGGGAGTTTTGATGAGAGTGTTCATTTTGGGACTTCGCGTATTCTAGGAAATAGTATCGGTGGACTCTA
TGCCTTGGTCTTCTTCTTATTAAATACCTTTTTCCACGAAGCCTTTTGGGTGACCTTGGTAGTTGTTCCAATCTGCA
CCATGTTAACCATTATGACAAATGTAGCCATGAATAACAAAGCAGGGGTTATTGGTGGTAGCAGCTATGTTAAT
CATTACCCTATCAATTCCAAGTGGTGAGACAATTTTGTACGTGTTTGTGCGTGTATTAGAAACGTTTATGGGAGTT
TTTGTCGCAATTATCGTAAATTACGATATTGATCGTATTCGTCTCTTTTTAGAGAAAAAAGAAAAATAA 4178.2                                                      (SEQ. ID. NO. 310)
ATGAATAAATCAGAACACCGCCACCAACTTATACGCGCTCTTATCACAAAAAAACAAGATTCATACACAGGCTGAG
TTGCAAGCCCTTCTTGCTGAGAACGACATTCAAGTAACCCAGGCAACCCTCTCACGCGACATCAAAAATATGAAC
CTATCAAAAGTCCGCGAAGAAGATAGCGCTTATTATGTTCTTAACAATGGTTCCATCTCAAAATGGGAAAAACGTC
TCGAACTCTACATGGAAGACGCCCTTGTCTGGATGCGCCCAGTTCAACACCAAGTCCTACTAAAAACCCTTCCTGG
ACTGGCTCAATCCTTTGGTTCTATCATTGATACTTTGAGCTTCCCTGACGCTATCGCTACCCTTGTGGTAATGATG
TCTGTCTTATCATCTGTGAAGATGCAGATACTGCTCAAAAGTGCTTTGAAGAACTGAAAAAATTCGCCCCACCATT
TTTCTTTGAAGAATAA 4179.1                                                      (SEQ. ID. NO. 311)
ATGAAAAGTATAAAATTAAATGCTCTATCTTACATGGGAATTCGTGTCTTGAATATTATTTTTCCCATCCTAACTGG
AACCTATGTCGCGCGTGTCTTGGACCGAACTGACTATGGTTACTTCAACTCAGTCGACACTATTTTGTCATTTTTCT
TGCCCTTTGCAACTTATGGTGTCTATAACTACGGTTTAAGGGCTATCAGTAATGTCAAGGATAACAAAAAAGATCT
TAACAGAACCTTTTCTAGTCTTTTTTATTTGTGCATCGCTTGTACGATTTTGACCACTGCTGTCTATATCCTAGCCT
ATCCTCTTCTTTACTGATAATCCAATCGTCAAAAAGGTCTACCTTGTTATGGGGATTCAACTCATTCCGTATCCT
GATGCTGGTCTCTATTTTCTTATTTGTTAAAAATGAACACGATATTGTTGTCTATACACTTGTGATGAGTTTATCGA
CGCTGATTAACTACCTGATTAGTTATTTTTGGATTAAAAGAGACATCAAACTTGTTAAAATTCACCTAAGTGATTT
TAAACCACTCTTTCTCCCTCTGACAGCCATGTTAGTCTTTGCCAATGCCAATATGCTCTTCACTTTTTTAGATCGCC
TCTTCCTCGTTAAAACAGGGATTGATGTCAACGTTAGTTACTATACCATAGCTCAGCGAATTGTGACCGTTATAGC
```

TABLE 1-continued

TGGGGTTGTAACAGGTGCAATTGGAGTGAGTGTGCCTCGTCTCAGTTACTATCTGGGGAAAGGAGACAAAGAAGC
CTATGTTTCTCTGGTTAATAGAGGTAGTCGAATCTTTAACTTCTTTATCATTCCACTGAGTTTTGGACTCATGGTTT
TAGGACCAAATGCCATCCTACTTTACGGTAGTGAAAAATATATCGGAGGCGGCATCTTGACCTCTCTCTTCGCTTT
TCGTACGATTATCCTGGCCTTAGATACCATTCTTGGTTCCCAAATTCTCTTTACCAATGGCTATGAAAAACGTATC
ACAGTCTATACAGTCTTTGCTGGGCTACTCAATTTGGGCTTGAATAGTCTCCTTTTTTTTCAACCATATCGTGGCTCC
TGAATACTACTTACTGACAACTATGCTATCAGAGACTTCTCTACTTGTTTTCTATATCATTTTCATCCATAGAAAC
AACTCATCCACTTGGGACATATCTTTAGCTATACTGTTCGATACTCTCTCTTTTCACTTTCCTTTGTAGCAATTTATT
TCCTGATTAATTTCGTGTATCCTGTAGATATGGTCATTAATTTGCCATTTTTGATTA
ATACTGGTTTGATTGTCTTGCTATCAGCTATCTCTTATATTAGTCTACTTGTCTTCACAAAAGATAGCATTTTCTAT
GAATTTTTAAACCATGTCCTAGCCTTAAAAAATAAATTTAAAAAATCATAG 4179.2                                                      (SEQ. ID. NO. 312)
ATGAAACAACTAACCGTTGAAGATGCCAAACAAATTGAATTAGAAATTTTGGATTATATTGATACTCTCTGTAAAA
AGCACAATATCAACTATATTATTAACTACGGTACTCTGATTGGGGCGGTTCGACATGAGGGCTTTATCCCTTGGGA
CGACGATATTGATCTGTCCATGCCTAGAGAAGACTACCAACGATTTATTAACATTTTTCAAAAGGAAAAAAGCAA
GTATAAGCTCCTATCCTTAGAAACTGATAAGAACTACTTTAACAACTTTATCAAGATAACCGACAGTACGACTAAA
ATTATTGATACTCGAAATACAAAAACCTATGAGTCTGGTATCTTTATCGATATTTTCCCTATAGATCGCTTTGATGA
TCCTAAGGTCATTGATACTTGTTATAAACTGGAAAGCTTCAAACTGCTGTCTTTCAGTAAACATAAAAATATTGTC
TATAAGGATAGCCTTTTAAAAGATTGGATACGAACAGCCTTCTGGTTACTCCTTCGACCGGTTTCTCCTCGTTATTT
TGCAAATAAAATCGAGAAAGAAATTCAAAAATATAGTCGTGAAAATGGGCAATATATGGCTTTTATCCCTTCAAA
ATTTAAGGAAAAGGAAGTCTTCCCAAGTGGTACCTTTGATAAAACAATCGATTTACCCTTTGAGAATTTAAGCCTT
CCTGCACCTGAAAAATTTGATACTATTTTGACACAATTTTATGGAGATTATATGACCCTACCACCAGAAGAAAAAC
GCTTCTACAGTCATGAATTTCACGCTTATAAATTGGAGGATTAG 4179.3                                                      (SEQ. ID. NO. 313)
ATGATAAAAATCAATCATCTAACCATCACACAAAACAAAGATTTACGAGATCTTGTATCTGACCTAACCATGACC
ATCCAAGACGGGGAAAAGGTTGCTATTATTGGTGAAGAAGGAAATGGCAAATCAACCTTACTTAAAATTTTAATG
GGGGAAGCTTTGTCTGATTTCACTATCAAGGGAAACATCCAATCTGACTATCAGTCACTGGCCTACATTCCTCAAA
AAGTCCCTGAGGACCTAAAAAAGAAAACTTTACACGACTACTTCTTTTTAGATTCTATTGATTTAGACTACAGTAT
CCTCTATCGTTTGGCGGAGGAATTGCATTTTGATAGCAATCGTTTCGCAAGTGACCAAGAGATTGGCAATCTATCA
GGGGGCGAAGCTTTGAAAATTCAGCTTATCCATGAGTTAGCCAAACCCTTTGAGATTCTATTTTTAGATGAACCTT
CAAATGACCTAGACCTTGAGACAGTTGATTGGCTAAAAGGCCAGATTCAAAAGACCAGGCAAACCGTTATTTTCA
TTTCCCATGATGAAGACTTTCTTTCTGAAACGGCAGACACTATTGTTCACTTGCGACTGGTCAAACACCGTAAAGA
AGCGGAAACGCTAGTAGAGCATTTAGACTATGATAGCTATAGTGAGCAGAGAAAGGCTAATTTTGGCAAACAAAG
TCAGCAAGCTGCTAACAACCAAAGAGCCTACGATAAAACCATGGAAAAACATCGGAGAGTTAAGCAAAATGTAG
AAACTGCGCTTCGAGCTACCAAAGATAGTACTGCCGGTCGCCTATTGGCTAAAAGATGAAAACTGTCCTCTCAC
AAGAAAAACGCTACGAAAAGGCAGCTCAGTCATGACTCAAAAGCCACTTGAAGAGGAACAAATCCAACTTTTCT
TTTCAGACATCCAACCATTACCAGCTTCTAAAGTCTTAGTCCAACTGGAAAAAGAAAATTTGTCCATTGACGACCG
AGTTTTGGTTCAAAAACTACAACTAACTGTCCGTGGCCAAGAAAAATCGGTATTATCGG
GCCAAATGGTGTTGGGAAATCAACTCTGTTAGCCAAGTTACAGAGACTTCTGAATGATAAAAGAGAGATTTCACT
TGGTTTTATGCCACAAGATTACCACAAAAACTGCAATTGATTTTATCCCAATAGCCTATCTCAGTAAAACTGGG
GAAAAAGAGGAACTACAGAAAATCCAATCTCACCTAGCTAGTCTCAATTTCAGTTATCCAGAAATGCAGCATCAA
ATTCGCTCCTTATCTGGCGGACAACAGGGAAAACTCCTGCTTTTGGATTTAGTCCTGCGCAAACCAAACTTTCTCC
TGCTGGATGAACCCACACGAAACTTTTCTCCCACTTCTCAACCCCAAATCAGAAACTCTTTGCTACCTATCCAGG
CGGTCTCATCACTGTTTCGCATGACCGTCGTTTCTTAAAAGAAGTCTGCTCGATCATCTATCGCATGACAGAACAC
GGTTTGAAGCTAGTTAATTTAGAAGATTTATAA 4179.4                                                      (SEQ. ID. NO. 314)
ATGAAACCAAAAACATTTTACAACTTGCTTGCCGAGCAGAATCTTCCACTTTCGGACCAGCAAAAAGAACAATTT
GAACGTTATTTTGAGCTCTTGGTCGAGTGGAATGAGAAGATTAATTTGACGGCGATTACGGACAAGGAAGAAGTT
TATCTCAAACATTTTTACGATTCGATTGCACCCATTCTTCAAGGTTTGATTCCCAATGAAACTATCAAACTTCTTGA
TATCGGGGCTGGGGCAGGATTTCCTAGTCTACCAATGAAAATTCTCTATCCGGAGTTAGATGTGACCATTATTGAT
TCACTCAATAAGCGCATCAACTTCCTACAACTCTTGGCTCAAGAACTGGATTTGAACGGAGTTCATTTCTACCACG
GACGTGCCGAAGATTTTGCCCAAGACAAGAACTTCCGTGCTCAATATGATTTTGTAACAGCTCGTCGTGCGGTTGCCCG
TATGCAGGTCCTATCTGAATTGACTATTCCCTACCTTAAGGTTGGTGGCAAACTATTAGCACTCAAGGCTAGCAAT
GCGCCTGAGGAATTATTAGAAGCTAAGAATGCCCTCAATCTCCTTTTTAGTAAGGTCGAAGACAATCTCAgtACG
CCCTACCGAATAGAGATCCGCGCTATATCACAGTGGTAGAAAAGAAAAAAGAAACACCAAATAAATATCCACGTA
AGGCTGGTATGCCAAATAAACGCCCACTTTAA 4179.6                                                      (SEQ. ID. NO. 315)
ATGAGTATTAAACTAATTGCCGTTGATATCGACGGAACCCTTGTCAACAGCCAAAAGGAAATCACTCCTGAAGTTT
TTTCTGCCATCCAAGATGCCAAAGAAGCTGGTGTCAAAGTCGTGATTGCAACTGGCCGCCCTATCGCAGGCGTTGC
CAAACTTCTAGACGACTTGCAGTTGAGAGACGAGGGGGACTATGTGGTAACCTTCAACGGTGCCCTTGTCCAAGA
AACTGCTACAGGACATGAGATTATCAGCGAATCCTTGACTTATGAGGATTATCTAGATATGGAATTCCTCAGTCGC
AAGCTCGGTGTCCACATGCATGCCATTACCAAGGACGGTATCTATACTGCAAATCGCAATATCGGAAAATACACT
GTACACGAATCAACCCTCGTCAGCATGCCTATCTTCTACCGTACCCTGAAGAAATGGCTGGCAAAGAAATTGTTA
AATGTATGTTTATCGATGAACCAGAAATTCTCGATGCTGCGATTGAAAAAATTCCAGCAGAATTTTACGAGCGCTA
CTCCATCAACAAATCTGCTCCTTTCTACCTCGAACTCCTTAAAAAGAATGTAGACAAGGGTTCAGCCATTACTCAC
TTGGCTGAAAAACTCGGATTGACCAAAGATGAAACCATGGCAATCGGTGATGAAGAAATGACCGTGCCATGCTG
GAAGTCGTTGGAAACCCGTTGTCATGGAAATGGAAATCCAGAAATCAAAAAATCGCCAAATACATCACCAAA
ACAAATGACGAATCCGGCGTTGCCCATGCCATCCGAACATGGGTACTGTAA 4179.7                                                      (SEQ. ID. NO. 316)
ATGACTTGGATTATTCTTGGAGTTATCGCTCTTATTGTTATTTTTGTGATTGTTAGCTATAACGGTTTGGTTAAAAA
TCGTATGCAAACCAAGGAGGCTTGGAGTCAGATTGATGTTCAGTTGAAACGTCGCAATGACCTCTTGCCAAACTTG
ATTGAGACTGTAAAAGGTTATGCCAAATATGAAGGTTCTACCCTTGAAAAGGTGGCAGAACTACGTAACCAAGTG
GCGGCAGCGACTTCACCAGCAGAAGCTATGAAAGCCAGTGATGCCCTCACTCGTCAGGTTTCAGGTATTTTTGCAG
TTGCAGAAAGCTATCCAGATTTGAAAGCTAGTGCTAACTTTGTTAAATTGCAAGAGGAGTTGACAAACACAGAAA
ATAAAATTTCTTACTCTCGTCAACTCTATAACAGTGTTGTCAGCAACTACAATGTAAAATTAGAAACTTTCCCGAG

TABLE 1-continued

CAATATTATCGCTGGAATGTTTGGATTTAAAGCGGCAGATTTCCTTCAAACACCTGAAGAGGAAAAGTCGGTTCCT
AAAGTTGATTTTAGCGGTTTAGGTGACTAA 4179.8 (SEQ. ID. NO. 317)
ATGTTGTTTGATCAAATTGCAAGCAATAAACGAAAAACCTGGATTTTGTTGCTGGTATTTTTCCTACTCTTAGCTCT
TGTTGGTTATGCGGTTGGTTATCTCTTTATAAGATCTGGACTTGGTGGTTTGGTTATTGCACTGATTATCGGCTTTA
TCTACGCTTTGTCTATGATTTTTCAATCGACAGAGATTGTCATGTCCATGAATGGAGCGCGTGAGGTGGATGAGCA
AACGGCACCAGACCTCTACCATGTAGTGGAAGATATGGCTCTGGTCGCTCAGATTCCTATGCCCCGTGTTTTCATC
ATTGATGATCCAGCCTTAAATGCCTTTGCGACAGGTTCTAATCCTCAAAATGCGGCTGTTGCTGCGACTTCAGGTC
TACTAGCTATCATGAATCGTGAAGAACTAGAAGCTGTTATGGGACATGAAGTCAGTCATATTCGTAATTATGATAT
CCGTATTTCGACTATTGCAGTTGCCCTTGCTAGTGCTATCACCATGCTTTCTAGTATGGCAGGTCGTATGATGTGGT
GGGGTGGAGCAGGTCGCAGACGAAGTGATGATGACCGAGATGGAAATGGTCTTGAAATCATTATGCTAGTGGTTT
CCCTACTAGCTATTGTACTGGCACCTCTCGCTGCAACCTTGGTTCAGCTCGCTATTTCTCGTCAGAGGGAATTTCTG
GCAGATGCATCTAGTGTCGAGCTGACTCGCAATCCCCAGGGAATGATTAATGCCCTAGATAAGTTGGACAATAGC
AAACCTATGAGTCGCCACGTCGATGATGCTAGCAGTGCCCTTTATATCAATGATCCTAAGAAAGGTGGGGGGTTC
CAAAAACTCTTTTATACCCACCCACCTATCTCAGAACGGATTGAACGTTTAAAACAGATGTAA 4179.9 (SEQ. ID. NO. 318)
ATGAAATTAAATATTCAAGAAATTCGTAAGCAGTCTGAAGGTTTGAACTTTGAACAAACGTTAGATTTAGTTGATG
ACCTGCGTGCACGTAATCAAGAAATTTTAGATGTAAAAGATATCCTTGCAGTTGGGAAAGTACAATATGAAGACC
GTATGTATTTCTTAGATTATCAACTATCTTATACCATTGTTCTTGCTTCGAGTCGCAGTATGGAGCCAGTTGAGTTA
GTTGAATCTTATCCAGTCACGGAAGTTTTCATGGAAGGCGCAACTAACCAGCTAGATCAAGAAGTTTTAGATGATG
ACTTGGTCTTGCCCATCGAAAATGGGGAGCTTGACCTTGCTGAGAGTGTATCAGACAATATCCTGCTAAACATTCC
TATCAAGGTCTTGACGGCTGAAGAAGAAGCTGGTCAAGGATTTATCTCAGGAAATGACTGGCAAATCATGACAGA
GGAAGAATACCAAGCTCAAAAAGCAGTAAAGAAAGAAGAAAACAGTCCTTTTGCTGGCTTACAAGGACTATTTGA
CGGAGATGAATAA 4179.12 (SEQ. ID. NO. 319)
ATGGAGTTATTTATGAAAATCACAAACTATGAAATCTATAAGTTAAAAAAATCAGGTTTGACCAATCAACAGATTT
TGAAAGTGCTAGAATACGGTGAAAATGTTGATCAGGAGCTTTTGTTGGGTGATATTGCAGATATCTCAGGTTGCCG
TAATCCAGCCGTTTTTATGGAACGTTATTTTCAGATAGACGATGCGCATTTGTCGAAAGAGTTTCAAAAATTTCCA
TCTTTCTCTATTTTAGATGACTGTTATCCTTGGGATTTGAGTGAAATATATGATGCGCCTGTACTTTTATTTTACAA
GGGAAATCTTGACCTCCTGAAATTCCCGAAGGTAGCGGTCGTGGGCAGTCGTCGTTGTAGCAAACAGGGAGCTAA
GTCAGTTGAAAAAGTCATTCAAGGCTTGGAAAATGAACTGGTTATTGTCAGTGGTCTGGCCAAGGGCATTGACAC
AGCAGCTCTATATGGCAGCTCTTCAGAATGGCGGAAAAACCATTGCAGTGATTGGAACAGGACTGGATGTGTTTTA
TCCTAAAGCCAATAAACGCTTGCAAGACTACATCGGCAATGACCATCTGGTTCTAAGTGAATATGGACCTGGTGA
ACAACCTCTGAAATTTCATTTTCCTGCCCGTAATCGCATCATTGCTGCATTTGTCGTGGTGTGATTGTAGCAGAG
GCTAAGATGCGTTCAGGTAGTCTCATTACGTGTGAGCGAGCAATGGAAGAAGGACGCGATGTCTTTGCTATTCCTG
GTAGCATTTTAGATGGACTATCAGACGGTTGCCATCATTTGATTCAAGAAGGAGCAAAATTGGTCACCAGTGGGC
AAGATGTTCTTGCGGAATTTGAATTTTAA 4181.1 (SEQ. ID. NO. 320)
ATGAAACGTCAATTAGCCTTGGTCGTCTTTAGTGGTGGTCAAGATTCAACAACCTGCCTTTTCTGGGTCATGCAAC
ACTATGAAACAGTCGAAGCTGTCACCTTTGCCTACGGCCAACGTCATCACCTCGAAATTCAAATTACTAGAGAAAT
CGCTAAGGAACAGGGCATTCGTCACCATATCCTCGATATGTCTCTGCTGGGACAAATCACTGCTCAGCCAGACTTT
GCGACGATTCATATTTCCTACATTCCTGACAAGCTCTGTGTCGAGTCAAAATCCCTCAAACTATATCTATTTAGCT
ACCGAAACCACGGAGATTTCCACGAAAACTGTATCAACACCATCGGGAAAGACTTGGTCAACTTGCTAGACCCTC
GCTATTTAGAAGTCTGGGGAAAATTCACTCCGCGCGGTGGCATTTCAATCGACCCCTACTACAACTACGGTAAGCA
AGGAACTAAGTATGAGGGCTTGGCAGAACAACGCCTCTTCCAACACGACCTTTATCCAGAGAAAATTGACAACCG
CTAA 4181.2 (SEQ. ID. NO. 321)
ATGACCGAAACGGTAGAAGATAAAGTAAGTCATTCAATTACTGGGCTTGATATCCTCAAGGGGATAGTTGCTGCG
GGAGCTGTCATAAGTGGAACCGTTGCAACTCAAACGAAGGTATTTACAAATGAGTCAGCAGTACTTGAAAAAACT
GTAGAGAAAACGGATGCTTTGGCAACAAATGATACAGTAGTTCTAGGTACGATATCTACAAGTAATTCAGCGAGT
TCAACTAGTTTGTCAGCTTCAGAGTCGGCAAGTACATCTGCATCTGAGTCAGCCTCAACCAGCGCTTCGACCTCAG
CAAGTACAAGTGCATCAGAATCAGCAAGTACATCGGCTTCGACAAGTATTTCTGCATCATCTACTGTGGTAGGTTC
ACAAACAGCTGCCGCTACAGAAGCAACTGCTAAGAAGGTCGAAGAAGATCGTAAGAAACCAGCTAGTGATTATGT
AGCATCAGTTACAAATGTCAATCTCCAATCTTATGCTAAGCGACCAAGCGTTCAGTGGATTCCATCGAGCAATTG
CTGGCTTCTATAAAAATGCTGCTGTTTTTTCTGGCAATACGATTGTAAATGCGCCCCTGCAATTAATGCAAGTC
TAAACATTGCTAAAAGTGAGACAAAAGTTTATACAGGTGAAGGTGTAGATTCGGTATATCGTGTTCCAATTTACTA
TAAATTGAAAGTGACAAATGATGGTTCAAAATTGACCTTTACCTATACGGTTACGTATGTGAATCCTAAAACAAAT
GATCTTGGTAATATATCAAGTATGCGTCCTGGATATTCTATCTATAATTCAGGTACTTCAACACAAACAATGTTAA
CCCTTGGCAGTGATCTTGGTAAACCTTCAGGTGTAAAGAACTACATTACTGACAAAAATGGTAGACAGGTTCTATC
CTATAATACATCTACAATGACGACGCAGGGTAGTGGGTATACTTGGGGAAATGGTGCCCAAATGAATGGTTTCTTT
GCTAAGAAAGGATATGGATTAACATCATCTTGGACTGTACCAATTACGGAACGGA
TACATCCTTTACATTTACCCCTTACGCTGCTAGAACAGATAGAATTGGAATTAACTACTTCAATGGTGGAGGAAAG
GTAGTTGAATCTAGCACGACCAGTCAGTCACTTTCACAGTCTAAGTCACTCTCAGTAAGTGCTAGTCAAAGCGCCT
CAGCTTCAGCATCAACAAGTGCGTCGGCTTCAGCATCAACCAGTGCCTCGGCTTCAGCGTCAACCAGTGCGTCAG
CTTCAGCAAGTACCAGTGCTTCAGTCTCAGCATCAACAAGTGCCTCGGCTTCAGCAAGTACCAGTGCTTCAGCTTCAGC
AGCAAGCACATCAGCATCTGAATCAGCGTCAACCAGTGCTTCGGCTTCAGCAAGTACCAGTGCTTCAGCTTCAGC
ATCAACCAGCGCCTCGGCCTCAGCAAGCACCTCAGCTTCTGAATCGGCCTCAACCAGCGCCTCAGCCTCAGCAAG
CACCTCAGCTTCTGAATCGGCCTCAACCAGCGCCTCAGCCTCAGCATCAACGAGTGCTTCGGCTTCAGCAAGCAC
AAGCGCCTCGGGTTCAGCATCAACGAGTACGTCAGCTTCGCGTCAACCAGTGCTTCGACTCAGCATCAACAACAAG
TGCGTCAGCTCAGCAAGTATCTCAGCGTCTGAATCGGCATCAACGAGTGCCTCTGAGTCAGCATCAACGAGTAC
GTCAGCCTCAGCAAGCACCTCAGCTTCTGAATCGGCCTCAACCAGTGCGTCAGCCTCAGCATCGACAAGCGCCTC
AGCTTCAGCAAGTACCAGTGCTTCAGCCTCAGCGTCGACAAGTGCGTCGGCCTCAACCAGTGCATCTGAATCGGC
ATCAACCAGTGCGTCAGCCTCAGCAAGTACTAGTGCATCGGCTTCAGCATCAACCAGTGCCTCGGCTTCAGCGTCA
ACCAGTGCGTCAGCTTCAGCAAGTACCAGTGCTTCAGTCTCAGCATCAACAAGTGCTTCAGCCTCAGCATCGACA

TABLE 1-continued

```
AGTGCCTCGGCTTCAGCAAGCACATCAGCATCTGAATCAGCGTCGACAAGCGCCTCAGCTTCAGCAAGTCCCAGT
GCGTCAGCTTCAGCATCAACCAGCGCCTCGGCCTCAGCAAGCACCTCAGCTTCTGAATCGGCCTCAACCAGCGCC
TCGGCCTCAGCAAGCACCTCAGCTTCTGAATCGGCCTCAACCAGCGCCTCAGCCTCAGCATCAACCAGTGCTTCG
GCTTCAGCAAGCACAAGCGCCTCGGGTTCAGCATCAACGAGTACGTCAGCTTCAGCGTCAACCAGTGCTTCAGCC
TCAGCATCAACAAGTGCGTCAGCCTCAGCAAGTATCTCAGCGTCTGAATCGGCATCAACGAGTGCGTCTGAGTCA
GCATCAACGAGTACGTCAGCCTCAGCAAGCACCTCAGCTTCTGAATCGGCCTCAACCAGTGCGTCAGCCTCAGCA
TCGACAAGCGCCTCAGCTTCAGCAAGTACCAGTGCTTCAGCCTCAGCTCGACAAGTGCGTCGGCCTCAACCAGTG
CATCTGAATCGGCATCAACCAGTGCGTCAGCCTCAGCAAGTACTAGTGCATCAGCTTCAGCATCAACGAGTGCAT
CGGCTTCAGCATCAACCAGTGCCTCGGCTTCAGCGTCAACCAGTGCGTCAGCTTCAGCAAGTACCAGTGCTTCAGT
CTCAGCATCAACAAGTGCTTCAGCCTCAGCATCGACAAGTGCcTCGGCTTCAGCAAGCACATCAGCATCTGAATCA
GCGTCGACAAGCGCcTCAGCTTCAGCAAGTACCAGTGCGTCAGCCTCAGCGTCGACAAGTGCGTCAGCCTCAGCA
AGTACTAGTGCATCAGCTTCAGCATCAACGAGTGCATCGGCTTCAGCGTCGTCAACCAGTGCATCAGAGTCAGCAAGT
ACCAGTGCGTCAGCTTCCGCATCAACAAGTGCCTCGGCTTCAGCAAGCACCAGTGCGTCGGCTTCAGCAAGTACT
AGCGCCTCAGCCTCAGCCTCAACCAGTGCGTCAGCCTCAGCAAGTATCTCAGCGTCTGAATCGGCATCAACGAGT
GCGTCCGCTTCAGCAAGTACTAGCGCCTCAGCCTCAGCGTCAACAAGTGCATCGGCTTCAGCGTCAACGAGTGCG
TCTGAATCGGCATCAACGAGTGCGTCCGCTTCAGCAAGTACTAGCGCCTCAGCCGTCAACAAGTGCATCG
GCTTCAGCATCAACGAGTGCGTCCGCTTCAGCAAGTACTAGCGCCTCAGCCTCAGCGTCAACAAGTGCATCGGCTT
CAGCGTCAACGAGTGCGTCTGAGTCAGCATCAACGAGTGCGTCAGCCTCAGCAAGCACATCAGCTTCTGAATCTG
CATCAACCAGTGCGTCAGCCTCAGCATCGACAAGCGCCTCAGCTTCAGCAAGTACCAGTGCGTCAGCCTCAGCGT
CGACAAGTGCGTCGGCTTCAGCAAGTACCAGTGCGTCAGCCTCAGCAAGTACCAGTGCGTCAGCCTCAGCGTCGA
CAAGTGCGTCGGCCTCAACCAGTGCATCTGAATCGGCATCAACCAGTGCGTCAGCCTCAGCAAGTACTAGTGCAT
CAGCTTCAGCATCAACGAGTGCATCGGCTTCAGCATCAACCAGTGCATCAGAGTCAGCAAGTACCAGTGCGTCAG
TTCCGCATCAACAAGTGCCTCGGCTTCAGCAAGTACTAG
```

4183.1 (SEQ. ID. NO. 322)
```
ATGGGGGTCGAAACTTGGTTTTATTCTAGCATCTGCTGGCTGGCCATCGGGCTTGGTTCCGTTTGGAAGTTTCCCT
ACATGACTGCTGCTAATGGCGGTGGAGGCTTTTTACTAATCTTTCTCATTTCCACTATTTTAATCGGTTTCCCTCTC
CTGCTGGCTGAGTTTGCCCTTGGCCGTAGTGCTGGCGTTTCCGCTATCAAACCTTTGGAAAACTGGGCAAGAATA
ACAAGTACAACTTTATCGGTTGGATTGGCGCCTTTGCCCTCTTTATCCTCTTCCTTTTTTACAGTGTTATCGGAGGA
TGGATTCTAGTCTATCTAGGTATTGAGTTTGGGAAATTGTTCCAACTTGGTGGAACGGGTGATTATGCTCAGTTAT
TTACTTCAATCATTTCAAATCCAGCCATTGCCCTAGGAGCTCAAGCGGCCTTTATCCTATTGAATATCTTCATTGTA
TCACGTGGGGTTCAAAAAGGGATTGAAAGAGCTTCGAAAGTCATGATGCCCCTGCTCTTTATCGTCTTTGTTTTA
TCATCGGTCGTCTCTCAGTTTGCCAAATGCCATGGAAGGGGTTCTTTACTTCCTCAAACCAGACTTTTCAAAACT
GACTAGCACTGGTCTCCTCTATGCTCTGGGACAATCTTTCTTTGCCCTCTCACTAGGGGTTACAGTCATGTTGACCT
ATGCTTCTTACTTAGACAAGAAAACCAATCTAGTCCAGTCAGGAATCTCCATCGTAGCCATGAATATCTCGATATC
CATCATGGCAGGTCTAGCCATTTTCCAAGCTCGATCCCCCTTCAATATCCAGTCTGAAGGGGGACCCAGCCTGCTC
TTTATCGTCTTGCCTCAACTCTTTGACAAGATGCCTTTTGGAACCATTTTCTACGTCCTCTTCCTCTTGCTCTTCCTT
TTTGCGACAGTCACTTTTTCTGTCGTGATGCTGGAAATCAATGTAGACAATATCACCAACCAGGATAACAGCAAAC
GTGCCAAATGGAGTGTTATTTTAGGAATTTTGACCTTTGTCTTTGGCATTCCTTCAGCCCTATCTTACGGTGTCATG
GCGGATGTTCACATTTTTGGTAAGACCTTCTTTGACGCTATGGACTTCTTGGTTTCCAATCTCCTCATGCCATTTGG
AGCTCTCTACCTTTCACTTTTTACAGGCTATATCTTTAAAAAGGCTCTTGCAATGGAGGAACTCCATCTCGATGAA
AGAGCATGGAAACAAGGACTGTTCCAAGTCTGGCTCTTCCTTCTTCGTTTCTTCGTTTCGTCATTCCAATCATCATC
ATTGTGGTCTTCATTGCCCAATTTATGTAATCAAAAAGGACTTGAGTAG
```

4183.5 (SEQ. ID. NO. 323)
```
ATGTTGAAAAAATGGCAGTTAAAAGATGTTATCTTGCTTGCTTTCTTGTCTATCTTTTTTGGTGGGGTTTTCGTTGG
TTCAGGATATGTGTATAATATTCTCAGTCTACTCTTAACACCTCTTGGTTTGCAGGCCTTTGCCAATGAAATCCTCT
TCGGTCTCTGGTGTATGGCTGCGCCCATTGCTGCCATCTTTGTTCCGAGAGTCGGAAGTGCAACGATTGGAGAAGT
GCTAGCTGCGCTTGCTGAAGTCCTTTATGGTAGCCAATTTGGTCTAGGAGCTCTTTTGTCTGGCTTTGTTCAAGGTT
TGGGAAGTGAATTTGGTTTTTATCGTAACTAAGAATCGCTATGAAAGTTGGCTCTCTAACTGCTAATAGTATTGG
GATTACGCTTGTTAGCTTTGTCTATGAATACATTAAGTTAGGTTACTACGCCTTTTCCCTTCCGTTTGTCCTTTCCTT
GCTTGTGGTACGTTTTATTTCTGTTTATTTCTTCTGTACCATCTTGGTTCGTGCCATTGTCAAACTCTATCATCAGTT
TGCAACTGGAGGAAAAGCATAG
```

4183.6 (SEQ. ID. NO. 324)
```
ATGGTCAAAGTAGCAACCCAGACACCGATTATCAGTCTCTTCTTGCTGATTTATCCTTGGAAACATCTTTCATTCC
TTCGATTGCTCTGACTCTTTCGGTAGTCGCATTTTGTATTCTCTTTATGCTCTATTACCGTCGATTTAAAATGTTAG
CTTGGATGATCATACTTGCCATTTTTACCATCTTTTGCCAACTACTGGGCAGTTCAGTTACACGGAGATGCTTCACA
GGCAGTCATGCTTGGAACGAGGGCCTTTGTGACAGTTTGTATCGGCCTTGTCTTTGTTTCCTCTGTTTCACTAAAAG
AGCTTCTCTTGTACTTGGCTCAAAAGGGGCTATCACGCTCTTGGTCCTATGCCTTGATTGTGGTATTCAATTCTTTT
CCTCTCATTCAGCAAGAAATCAAGTCCCTCAAAGAAGCTTGCCTATTACGTGGTCAAGAACTACATTTTTGGTCGC
CCTTGATTTACAGTAAGGTTCTGATGACAGTCTTTAGGTGGCGCCATCTTTACCTGAGAGCTCTATCTGCTCACGG
ATATGACGAACATGCACAGTTGAAGAATAGCTATCGGACTTTTTATATTCCTAAAAAAACAAAATTAATCTACCTG
CTTTTCTTTTTATTGCTTCAAACCAGTCTATTTTTATAA
```

4183.7 (SEQ. ID. NO. 325)
```
ATGAGAAAGCACCAATTACAAGTTCACAAATTAACCATTTTATCTATGATGATTGCCCTTGATGTAGTCCTTACAC
CTATCTTTCGAATTGAGGGAATGGCACCGATGTCCAGTGTAGTCAATATTCTAGCAGGAATCATGATGGGACCTGT
TTATGCCTTGGCTATGGCTACAGTCACAGCCTTTATCCGTATGACGACTCAAGGGATTCCGCCTTTAGCTCTCACA
GGAGCGACTTTTGGAGCCCTTCTAGCAGGTCTCTTTTATAAGTACGGTCGAAAATTTCACTATTCTGCTCTAGGAG
AGATTTGGGAACAGGTATTATTGGTTCCATTGTTTCCTATCCTGTTATGGTACTCTTTACAGGATCAGCTGCTAAG
CTTAGCTGGTTTATCTACACGCCTCGATTTTCGGAGCAACCTTGATTGGTACAGCGATTTCCTTTATTGCCTTTCG
ATTTTTAATCAAGCAGGAATTCTTTAAAAAAGTGCAGGGATATTTCTTTAGTGAAAGGATAGACTGA
```

4183.8 (SEQ. ID. NO. 326)
```
ATGCAGGAATTTACAAATCCCTTTCCTATAGGCTCTAGTTCCCTCATTCACTGCATTACCAATGAGATTCTTGTGA
GATGCTGGCAAATGGGATTTTGGCTCTGGGATGCAAACCTGTCATGGCAGATGATTCCCGTGAAGTTCTTGATTTT
ACTAAGCAAAGTCAGGCTCTCTTCATCAATTTGGGGCATTTGTCAGCTGAGAAGGAAAAAGCAATCCGCATGGCA
GCTTCGTATGCAAACCAATCTTCTCTCCCGATGGTAGTAGATGCGGTTGGCGTAACGACTTCATCCATTCGTAAGA
```

TABLE 1-continued

GCTTAGTTAAAGACCTTTTAGACTATAGACCTACGGTCCTTAAAGGAAACATGTCAGAAATTCGAAGTCTTGTTGG
ATTAAAGCACCACGGCGTTGGGGTCGATGCGAGTGCTAAAGATCAAGAAACGGAGGATTTGCTTCAAGTCTTGAA
AGACTGGTGTCAGACCTATCCTGGTATGTCTTTCTTAGTCACAGGTCCCAAGGACCTCGTCGTTTCGAAAAATCAG
GTCGCTGTACTGGGAAATGGCTGTACTGAATTAGACTGGATAACAGGGACAGGAGACTTGGTTGGAGCCTTAACA
GCTGTTTTTCTCAGCCAAGGAAAGACTGGTTTTGAAGCTTCTTGCTTAGCAGTCTCTTATCTCAATATCGCTGCTGA
GAAAATAGTTGTTCAAGGAATGGGATTGGAAGAATTTCGTTACCAAGTACTCAATCAGCTTTCGCTCCTAAGAAG
AGATGAAAATTGGCTAGATACCATCAAAGGAGAGGTTTATGAATAG 4185.3                                                                 (SEQ. ID. NO. 327)
ATGAACCATAAAATCGCAATTTTATCAGATGTTCATGGCAATGCGACGGCGCTAGAAGCAGTGATTGCAGATGCT
AAAAATCAAGGGGCCAGTGAATATTGGCTTCTGGGAGATATTTTTCTTCCTGGTCCAGGCGCAAATGACTTAGTCG
CCCTGCTAAAGGACCTTCCTATCACAGCAAGTGTTCGAGGCAATTGGGATGATCGTGTCCTTGAGGCTTTAGATGG
GCAATATGGCTTAGAAGACCCACAGGAAGTTCAGCTCTTGCTATGACACAGTATTTGATGGAGCGAATGGATCC
TGCAACGATTGTCTGGCTACGAAGCTTGCCTTTGCTGGAAAAGAAAGAAATTGACGGATTGCGCTTTTCTATCTCT
CATAATTTACCTGACAAAAACTATGGTGGTGACTTGCTAGTTGAGAATGATACAGAGAAATTTGACCAACTGCTA
GATGCGGAAACGGACGTGGCAGTTTATGGTCATGTTCACAAGCAGTTGCTTCGTTATGGAAGTCAAGGGCAACAA
ATCATCAATCCAGGGTCGATTGGCATGCCCTATTTTAATTGGGAGGCGTTAAAAAATCACCGTTCCCAGTATGCCG
TGATAGAAGTTGAAGATGGGGAATTACTCAATATCCAATTTCGTAAAGTTGCTTATGATTACGAAGCTGAGTTAGA
ATTGGCCAAGTCCAAGGGGCTTCCCTTTATCGAAATGTATGAAGAACTGCGTCGTGACGATAACTATCAGGGGCA
CAATCTGGAATTATTAGCCAGCTTAATAGAAAAGCATGGGTATGTAGAGGATGTGAAGAATTTTTTTGATTTTTTG
TAA 4186.1                                                                 (SEQ. ID. NO. 328)
ATGAATGTAAATCAGATTGTACGGATTATTCCTACTTTAAAAGCTAATAATAGAAAATTAAATGAAACATTTTATA
TTGAAACCCTTGGAATGAAGGCCTTGTTAGAAGAATCGGCCTTTCTGTCACTAGGTGACCAAACGGGTCTTGAAAA
GCTGGTTTTAGAAGAAGCTCCCAGTATGCGTACTCGTAAGGTAGAGGGAAGAAAAAAACTAGCTAGATTGATTGT
CAAGGTGGAAAATCCCTTAGAAATTGAAGGAATCTTATCTAAAACAGATTCGATTCATCGATTATATAAAGGTCA
AAATGGCTACGCTTTTGAAATTTTCTCACCAGAAGATGATTTGATTTTGATTCATGCGGAAGATGACATAGCAAGT
CTAGTAGAAGTAGGAGAAAAGCCTGAATTTCAAACAGATTTGGCATCAATTTCTTTAAGTAAATTTGAGATTTCTA
TGGAATTACATCTCCCAACTGATATCGAAAGTTTCTTGGAATCATCTGAAATTGGGGCATCCCTTGATTTTATTCC
AGCTCAGGGCAGGATTTGACTGTGGACAATACGGTTACCTGGGACTTATCTATGCTCAAGTTCTTGGTCAATGAA
TTAGACATAGCAAGTCTTCGCCAGAAGTTTGAGTCTACTGAATATTTTATTCCTAAGTCTGAAAAATTCTTCCTTG
GTAAAGATAGAAATAATGTTGAATTGTGGTTTGAAGAAGTATGA 4186.2                                                                 (SEQ. ID. NO. 329)
ATGAAGTGGACCAAGATTATTAAAAAAATAGAAGAACAAATCGAGGCAGGGATTTATCCCGGAGCCTCTTTTGCG
TATTTTAAGGACAATCAATGGACAGAGTTCTATTTAGGCCAGGATGACCCAGAGCATGGCTTGCAGACTGAGGCA
GGACTAGTTTATGACCTAGCTAGTGTCAGCAAGGTTGTTGGGGTTGGCACAGTTTGTACCTTCTTGTGGGAAATAG
GTCAATTAGATATTGATAGACTGGTAATAGATTTTTTACCTGAGAGTGATTATCCAGACATCACTATTCGCCAGCT
CTTGACTCATGCAACAGACCTTGATCCTTTTATTCCTAATCGTGATCTTTTAACAGCCCCTGAATTAAAGGAAGCG
ATGTTTCATCTCAACAGACGAAGTCAGCCAGCCTTTCTTTATTCGGATGTCCATTTTTTGCTGTTGGGCTTTATTT
GGAAAGAATTTTTAATCAAGATTTGGATGTGATTTTAAAGGATCAAGTCTGGAAACCTTGGGGAATGACGGAAAC
TAAGTTTGGGCCAGTTGAGCTTGCTGTTCCAACAGTTAGAGGGTGTAGAGGCAGGCATAGTGCATGATCCCAAGGC
TCGTCTCCTGGGTAGACATGCTGGGAGTGCTGGTTTATTTTCGACTATAAAGGATTTACAAATCTTTTTAGAACAC
TATTTAGCAGATGATTTTGCAAGAGACTTAAATCAAAATTTTTCTCCTTTGGATGACAAGGAACGTTCTTTAGCAT
GGAATTTGGAAGGAGATTGGCTAGACCATACGGGCTATACAGGTACCTTTATCATGTGGAATCGTCAGAAGCAAG
AAGCCACTATTTTCCTATCGAATCGTACCTATGAAAAGGACGAGAGAGCTCAATGGATATTAGACCGCAATCAAG
TGATGAACTTGATTCGCAAAGAAGAGTAA 4187.2                                                                 (SEQ. ID. NO. 330)
ATGATGAAGAAGACTTATAATCATATTTTGGTCTGGGGAGTCATTTTCTATAGCATTTGCATTGTCTGTTTTTGCTT
TACTCCTCAAGAACAATCTACCGTGGGAGTGGGAACTCCAGGTATTCAGCATCTTGGACGCCTGGTTTTTCTTTTG
ACTCCTTTCAATTCTCTCTGGAAACTGGGCGAAGTGAGTGACATTGGACAATTATGTTGGATTTTTTTACAAAATA
TCCTCAATGTCTTCTTGTTTTTTCCTCTGATTTTCCAACTCCTTTATCTATTTCCAAATTTGCGGAAAACAAAAAAG
GTCCTTCTTTTTAGTTTTCTTGTGAGTCTTGGAATCGAGTGTACGCAATTAATCTTGGACTTTTTCTTTGATTTCAAT
CGCGTCTTTGAGATTGATGATTTGTGGACCAACACTTTGGGTGGCTATCTGGCTTGGCTCCTTTATAAACGATTAC
ATAAAAACAAGGTAAGGAATTAA 4188.1                                                                 (SEQ. ID. NO. 331)
ATGAAGATTCCTCTCTTAACTTTTGCAAGGCATAAATTTGTTTATGTCTTGCTTACTTTGCTTTTTCTTGCTTTGGTT
TATCGTGATGTTTTGATGACTTATTTCTTTTTTGATATTCATGCGCCCGATCTAGCTAAATTCGATGGACAAGCAAT
TAAAAATGACTTATTAAAATCAGCATTAGATTTTCGTATTCTCCAGTTCAATCTAGGTTTTTTATCAATCATTTATTA
TTCCAATCATCATTGTTTTGCTAGGTTTTCAATATATTGAGCTGAAAAATAAAGTTTTACGATTGAGTATTGGAAG
AGAAGTGAGTTATCAAGGGTTAAAAGAAAGTTGACTTTGCAAGTTGCAAGTATCCCTTGTTTGATATATTTAGTG
ACTGTGCTGATAATTGCAATTATAACCTATTTCTTTGGGACTTTTTCTCCTCTTGGATGGAATTCTCTATTTTCTGAT
GGAAGTGGTTTACAAAGACTCCTAGATGGAGATAAAAAGCTATTTGTTCTTTACTTGTCCTACTAATCGGTA
TTTTCATCAATGCAATCTATTTTTTACAAATAGTTGATTATGTGGGAATGTGACTCGTTCGGCAATCACCTATTTG
ATGTTTCTTTGGCTTGGTTCTATGCTGCTTTATAGTGCCTTGCCTTACTATATGGTTCCTATGACGAGTTTGATGCA
AGCTAGCTATGGGGATGTAAGTTTGATGAAACTCTTTACTCCTTATATCCTTTATATTGTCCCTTACATGGTGCTTG
AAAAATATGAAGATAATGTTTAA 4188.2                                                                 (SEQ. ID. NO. 332)
ATGAAGATAATGTTTAAGAATTTTAACAATATTTTGCTAAATAGAAAGATTGTTTTACTACTTCGTATAGTTCTGAT
GATGATTTTGATAAACCATCTATTGTCAACAGCGGTTCAAACAGGATGCTGTTATCTTTTTCAAGAGAGAATTG
ATTTCAATTTTTTCCTATAATGACTATTCTGAAGCGAATTTAGAAATCCCCAAACTATTGTTAAACCTTTCGCTTTT
CATGGTAGGATGGCTCTCTGTCATTTTACTTGAAAGTGATTTGGCAGACCATTACCATCACTTGATTCGCTATCAA
TCAAGCTCCTTTTTCGATTATACAAGGAAACGATTGGTTGTCATTTCTAAATTTTTTACTCAAGATTTGTTTGTCTG
GTTTCTTGGTTTACTTCCTCTAGGAATTCATTTCAAAACAGTCGCACTTTTCTTTTTACTTGCTCAGTTAATGATGTT
GTACTTACTACTGTCTTATCTGATAGCACTGATTAGTGCGGGCGCTGGTTTTTCCTTTTTTCTCTATTTTTTAGCATT

TABLE 1-continued

TGTGGGACAAGAATGGATGATGGATCATATTGTAACAGTGTATTTAGTACTCTTAAGTTTATTAGTTATGTTGATT
GTTAGTCGCTTGGAAGAGAAATTTAAGAAAGGATAA 4188.5 (SEQ. ID. NO. 333)
ATGGGCAAAGGAGAGATGGGCAAAGGAGTTATTGGCTTGGAGTTCGACTCAGAAGTATTGGTCAACAAGGCTCCA
ACCCTTCAATTGGCAAATGGTAAAACAGCGACTTTCCTAACCCAGTATGATAGCAAGACCTTGTTGTTTGCAGTAG
ATAAGGAAGATATCGGACAGGAAATTATTGGTATAGCTAAAGGAAGCATCGAAAGTATGCATAATCTTCCTGTAA
ATCTAGCAGGTGCCAGAGTTCCTGGCGGAGTAAATGGTAGCAAAGCAGCGGTGCATGAAGTTCCAGAATTTACAG
GGGGAGTTAATGGTACAGAGCCAGCTGTTCATGAAATCGCAGAGTATAAGGGATCTGATTCGCTTGTAACTCTTAC
TACAAAAAAAGATTATACTTACAAAGCTCCTCTTGCTCAGCAGGCACTTCCTGAAACAGGAAACAAGGAGAGTGA
CCTCCTAGCTTCACTAGGACTAACAGCTTTCTTCCTTGGTCTGTTTACGCTAGGGAAAAAGAGAGAACAATAA 4188.10 (SEQ. ID. NO. 334)
ATGTTTAAAGTTTTACAAAAAGTTGGAAAAGCTTTTATGTTACCTATAGCTATACTTCCTGCAGCAGGTCTACTTTT
GGGGATTGGTGGTGCACTTTCAAACCCAACCACGATAGCAACTTATCCAATACTAGACAATAGTATTTTTCAATCA
ATATTCCAAGTAATGAGCTCTGCAGGAGAGGTTGTATTCAGTAATTTGTCACTACTTCTCTGTGTGGGATTATGTA
TTGGCTTAGCGAAACGAGATAAAGGAACCGCTGCGTTAGCAGGAGTAACTGGTTACTTAGTTATGACTGCAACGA
TCAAAGCTTTGGTAAAACTTTTTATGGCAGAAGGATCTGCAATTGATACTGGAGTTATTGGAGCATTAGTTGTCGG
AATAGTTGCCGTATATTTGCACAACCGATATAACAATATTCAATTACCTTCCGCTTTAGGATTCTTTGGAGGTTCA
CGCTTCGTTCCTATTGTTACATCGTTCTCTTCTATCTTGATTGGCTTTGTCTTCTGTTATTTGGCCACCTTTCCAA
CAACTTCTTGTTTCTACAGGTGGATATATTTCTCAGGCGGGTCCAATTGGAACTTTTCTATATGGATTTTTAATGAG
ACTTTCTGGAGCAGTAGGCTTACATCATATAATTTACCCTATGTTTTGGTATACTGAACTTGGTGGTGTTGAAACTG
TTGCAGGACAAACAGTGGTTGGAGCTCAAAAAATATTTTTTGCTCAATTAGCCGATTTGGCCCATTCTGGATTATT
TACAGAAGGAACAAGGTTTTTTGCAGGTCGTTTCTCAACAATGATGTTCGGTTTACCGGCTGCCTGTTTAGCGATG
TACCATAGTGTTCCTAAAAATCGTCGTAAAAAATACGCGGGTTTGTTTTTTGGAGTTGCTTTAACATCTTTTATTAC
CGGTATTACAGAACCAATTGAATTTATGTTCTATTCGTCAGTCCGGTTCTATATGTTGTTCACGCATTCCTTGATG
GTGTTAGCTTCTTTATTGCAGACGTCTTAAATATTTCAATAGGAAACACATTTTCAGGAGGTGTAATCGATTTCACT
TTATTTGGAATTTTGCAGGGGAACGCTAAGACGAATTGGGTTCTTCAGATTCCATTTGGACTTATTTGGAGTGTTTT
GTATTATATTATTTTTAGATGGTTCATTACTCAATTCAACGTTCTAACGCCCAGGGCGAGGAGAAGAAGTAGATTCT
AAAGAAATTTCTGAATCCGCAGATTCAACTTCAAATACTGCAGATTATTTAAAACAGGATAGCCTACAAATTATCA
GAGCCTTGGGTGGATCAAATAATATAGAAGATGTAGATGCTTGTGTGACACGTTTACGTGTAGCTGTAAAAGAAG
TTAATCAAGTTGATAAAGCACTTTTAAAACAAATTGGTGCAGTTGATGTCTTAGAAGTGAAGGGTGGCATTCAAGC
AATCTATGGAGCAAAAGCAATCTTATATAAAAATAGTATTAATGAAATTTTAGGTGTAGATGATTAA 4188.11 (SEQ. ID. NO. 335)
ATGAAATTTAGAAAATTAGCTTGTACAGTACTTGCGGGTGCTGCGGTTCTTGGTCTTGCTGCTTGTGGCAATTCTG
GCGGAAGTAAAGATGCTGCCAAATCAGGTGGTGACGGTGCCAAAACAGAAATCACTTGGTGGGCATTCCCAGTAT
TTACCCAAGAAAAAACTGGTGACGGTGTTGGAACTTATGAAAAATCAATCATCGAAGCGTTTGAAAAAGCAAACC
CAGATATAAAAGTGAAATTGGAAACCATCGACTTCAAGTCAGGTCCTGAAAAAATCACAACAGCCATCGAAGCAG
GAACAGCTCCAGACGTACTCTTTGATGCACCAGGACGTATCATCCAATACGGTAAAAACGGTAAATTGGCTGAGT
TGAATGACCTCTTCACAGATGAATTTGTTAAAGATGTCAACAATGAAAACATCGTACAAGCAGGTAAAGCTGGAG
ACAAGGCTTATATGTATCCGATTAGTTCTGCCCCATTCTACATGGCAATGACAAGAAAATGTTAGAAGATGCTGG
AGTAGCAAACCTTGTAAAAGAAGGTTGGACAACTGATGATTTTGAAAAGTATTGAAAGCACTTAAAGCAAGGG
TTACACACCAGGTTCATTGTTCAGTTCTGGTCAAGGGGGAGACCAAGGAACACGTGCCTTTATCTCTAACCTTTAT
AGCGGTTCTGTAACAGATGAAAAAGTTAGCAAATATACAACTGATGATCCTAAATTCGTCAAAGGTCTTGAAAAA
GCAACTAGCTGGATTAAAGACAATTTGATCAATAATGGTTCACAATTTGACGGTGGGGCAGATATCCAAACTTT
GCCAACGGTCAAACATCTTACACAATCCTTTGGGCACCAGCTCAAATGGTATCCAAGCTAAACTTTTAGAAGCA
AGTAAGGTAGAAGTGGTAGAAGTACCATTCCCATCAGACGAAGGTAAGCCAGCTCTTGAGTACCTTGTAAACGGG
TTTGCAGTATTCAACAATAAAGACGACAAGAAAGTCGCTGCATCTAAGAAATTCATCCAGTTTATCTGCAGATGAC
AAGGAGTGGGGACCTAAAGACGTAGTTCGTACAGGTGCTTTCCCAGTCCGTACTTCATTTGGAAAACTTTATGAAG
ACAAACGCATGGAAACAATCAGCGGCTGGACTCAATACTACTCACCATACTACAACACTATTGATGATTTGCTG
AAATGAGAACACTTTGGTTCCCAATGTTGCAATCTGTATCAAATGGTGACGAAAAACCAGCAGATGCTTTGAAAG
CCTTCACTGAAAAAGCGAACGAAACAATCAAAAAAGCTATGAAACAATAG 4188.12 (SEQ. ID. NO. 336)
ATGCAATCTACAGAAAAAAAACCATTAACAGCCTTTACTGTTATTTCAACAATCATTTTGCTCTTGTTGACTGTGC
TGTTCATCTTTCCATTCTACTGGATTTTGACAGGGCATTCAAATCACAACCTGATACAATTGTTATTCCTCCTCAG
TGGTTCCCTAAAATGCCAACCATGGAAAACTTCCAACAACTCATGATGCTGAGCTTGCAGAACCCTGCCTTGCAATGGATGTGG
AACTCAGTATTTATCTCATTGGTAACCATGTTCTTAGTTTGTGCAACCTCATCTCTAGCAGGTTATGTATTGGCTAA
AAAACGTTTCTATGGTCAACGCATTCTATTTGCTATCTTTATCGCTGCTATGGCGCTTCAAAACAAGTTGTCCTTG
TACCATTGGTACGTATCGTCAACTTCATGGGAATCCATGATACTCTCTGGGCAGTTATCTTGCCTTTGATTGGATG
GCCATTCGGTGTCTTCCTCATGAAACAGTTCAGTGAAAATATCCCTACAGAGTTGCTTGAATCAGCTAAAATCGAC
GGTTGTGGTGAGATTCGTACCTTCTGGAGTGTAGCCTTCCCGATTGTGAAACCAGGGTTTGCAGCCCTTGCAATCT
TTACCTTCATCAATACTTGGAATGACTACTTCATGCAATTGGTAATGTTGACTTCACGTAACAATTTGACCATCTCA
CTTGGGGTTGCGACCATGCAGGCTGAAATGGCAACCAACTATGGTTTGATTATGGCAGGAGCTGCCCTTGCTGCTG
TTCCAATCGTCACAGTCTTCCTAGTCTTCCAAAAATCCTTCACACAGGGTATTACTATGGGAGCGGTCAAAGGATA
A 4191.1 (SEQ. ID. NO. 337)
ATGAAAAAAACTTTTTTCTTACTGGTGTTAGGCTTGTTTTGCCTTCTTCCACTCTCTGTTTTTGCCATTGATTTCAAG
ATAAACTCTTATCAAGGGGATTTGTATATTCATGCAGACAATACGGCAGAGTTTAGACAGAAGATAGTTTACCAGT
TTGAGGAGGACTTTAAGGGCCAAATCGTGGGACTTGGACGTGCTGGTAAGATGCCTAGCGGGTTTGACATTGACC
CTCATCCAAAGATTCAGGCCGCGAAAAACGGTGCAGAACTAGCAGATGTGACTAGCGAAGTAACAGAAGAAGCG
GATGGTTATACTGTGAGAGTCTATAATCCAGGTCAGGAGGGCGAAGTAGTTGAAGTTGACCTCGTCTGGAACTTA
AAAAATTTACTTTTCCTTTATGATGATATCGCTGAATTAAATTGGCAACCTCTGACAGATAGTTCAGAGTCTATTG
AAAAGTTTGAATTTCATGTAAGGGGAGACAAGGGGGCTGAAAAACTCTTTTTCCATACAGGGAAACTTTTTAGAG
AGGGAACGATTGAAAAGAGTAACCTTGATTATACTATCCGTTTAGACAATCTTCCGGCTAAGCGTGGAGTTGAGTT
GCATGCCTATTGGCCTCGGACCGATTTTGCTAGCGCTAGGGATCAGGGATTGAAAGGGAATCGTTTAGAAGAGTTT
AATAAGATAGAAGACTCGATTGTTAGAGAAAAAAGATCAGAGTAAACAACTCGTTACTTGGGTCCTCCCCTTCGATC

TABLE 1-continued

```
CTTTCCATCTCCTTGTTATTGAGTGTCTGCTTCTATTTTATTTATAGAAGAAAGACCACTCCTTCAGTCAAATATGC
CAAAAATCATCGTCTCTATGAACCACCAATGGAATTAGAGCCTATGGTTTTATCAGAAGCAGTCTACTCGACCTCC
TTGGAGGAAGTGAGTCCCTTGGTCAAGGGAGCTGGAAAATTCACCTTTGATCAACTTATTCAAGCTACCTTGCTAG
ATGTGATAGACCGTGGGAATGTCTCTATCATTTCAGAAGGAGATGCAGTTGGTTTGAGGCTAGTAAAAGAAGATG
GTTTGTCAAGCTTTGAGAAAGACTGCCTAAATCTAGCTTTTTCAGGTAAAAAGAAGAAACTCTTTCCAATTTGTT
TGCGGATTACAAGGTATCTGATAGTCTTTATCGTAGAGCCAAAGTTTCTGATGAAAAACGGATTCAAGCAAGAGG
GCTTCAACTCAAATCTTCTTTTGAAGAGGTATTGAACCAGATGCAAGAAGGAGTGAGAAAACGAGTTTCCTTCTGG
GGGCTCCCAGATTATTATCGTCCTTTAACTGGTGGGGAAAAGGCCTTGCAAGTGGGTATGGGTGCCTTGACTATCC
TGCCCCTATTTATCGGATTTGGTTTGTTCTTGTACAGTTTAGACGTTCATGGCTATCTTTACCTCCCTTTGCCAATA
CTTGGTTTTCTAGGGTTAGTTTTGTCTGTTTTCTATTATTGGAAGCTTCGACTAGATAATCGTGATGGTGTTCTAAA
TGAAGCGGGAGCTGAGGTCTACTATCTCTGGACCAGTTTTGAAAATATGTTGCGTGAGATTGCACGATTGGATCAG
GCTGAACTGGAAAGTATTGTGGTCTGGAATCGCCTCTTGGTCTATGCGACCTTATTTGGCTATGCGGACAAGGTTA
GTCATTTGATGAAGGTTCATCAGATTCAAGTGGAAAATCCAGATATCAATCTCTATGTAGCTTATGGCTGGCACAG
TACGTTTTATCATTCAACAGCACAAATGAGCCATTATGCTAGTGTCGCAAATACAGCAAGCACCTACTCTGTATCT
TCTGGAAGTGGAAGTTCTGGTGGTGGCTTCTCTGGAGGCGGAGGTGGCGGCAGTATCGGTGCCTTTTAA 4191.2                                                              (SEQ. ID. NO. 338)
ATGAAAAAAGTAAGAAAGATATTTCAGAAGGCAGTTGCAGGACTGTGCTGTATATCTCAGTTGACAGCTTTTTCTT
CGATAGTTGCTTTAGCAGAAACGCCTGAAACCAGTCCAGCGATAGGAAAAGTAGTGATTAAGGAGACAGGCGAAG
GAGGAGCGCTTCTAGGAGATGCCGTCTTTGAGTTGAAAAACAATACGGATGGACACAACTGTTTCGCAAAGGACAG
AGGCGCAAACAGGAGAAGCGATATTTTCAAACATAAAAACCTGGGACATACACCTTGACAGAAGCCCAACCTCCAG
TTGGTTATAAACCCTCTACTAAACAATGGACTGTTGAAGTTGAGAAGAATGGTCGGACGACTGTCCAAGGTGAAC
AGGTAGAAAATCGAGAAGAGGCTCTATCTGACCAGTATCCACAAACAGGGACTTATCCAGATGTTCAAACACCTT
ATCAGATTATTAAGGTAGATGGTTCGGAAAAAAACGGACAGCACAAGGCGTTGAATCCGAATCCATATGAACGTG
TGATTCCAGAAGGTACACTTTCAAAGAGAATTTATCAAGTGAATAATTTGGATGATAACCAATATGGAATCGAATT
GACGGTTAGTGGGAAAACAGTGTATGAACAAAAAGATAAGTCTGTGCCGCTGGATGTCGTTATCTTGCTCGATAA
CTCAAATAGTATGAGTAACATTCGAAACAAGAATGCTCGACGTGCGGAAAGAGCTGGTGAGGCGACACGTTCTCT
TATTGATAAAATTACATCTGATTCAGAAAATAGGGTAGCGCTTGTGACTTATGCTTCCACTATCTTTGATGGGACC
GAGTTTACAGTAGAAAAAGGGGTAGCAGATAAAAACGGAAAGCGATTGAATTGATTCTCTTTTTTGGAATTATGAT
CAGACGAGTTTTACAACCAATACCAAAGATTATAGTTATTTAAAGCTGACTAATGATAAGAATGACATTGTAGAAT
TAAAAAATAAGGTACCTACCGAGGCAGAAGACCATGATGGAAATAGATTGATGTACCAATTCGGTGCCACTTTTA
CTCAGAAAGCTTTGATGAAGGCAGATGAGATTTTGACACAACAAGCGAGACAAAATAGTCAAAAAGTCATTTTCC
ATATTACGGATGGTGTCCCAACTATGTCGTATCCGATTAATTTTAATCATGCTACGTTTGCTCCATCATATCAAAT
CAACTAAATGCATTTTTTAGTAAATCTCCTAATAAAGATGGAATACTATTAAGTGATTTTTATTACGCAAGCAACTA
GTGGAGAACATACAATTGTACGCGGAGATGGGCAAAGTTACCAGATGTTTACAGATAAGACAGTTTATGAAAAG
GTGCTCCTGCAGCTTTCCCAGTTAAACCTGAAAAATATTCTGAAATGAAGGCGGCTGGTTATGCAGTTATAGGCGA
TCCAATTAATGGTGGATATATTTGGCTTAATTGGAGAGAGATTATTCTGGCTTATCCGTTTAATTCTAATACTGCTA
AAATTACCAATCATGGTGACCCTACAAGATGGTACTATAACGGGAATATTGCTCCTGATGGGTATGATGTCTTTAC
GGTAGGTATTGGTATTAACGGAGATCCTGGTACGGATGAAGCAACGGCTACTAGTTTTATGCAAAGTATTTCTAGT
AAACCTGAAAACTATACCAATGTTACTGACACGACAAAAATATTGGAACAGTTGAATCGTTATTTCCACACCATC
GTAACTGAAAAGAAATCAATTGAGAATGGTACGATTACAGATCCGATGGGTGACGGTTAATTGATTTGCAATTGGGC
ACAGATGGAAGATTTGATCCAGCAGATTACACTTTAACTGCAAACGATGGTAGTCGCTTGGAGAATGGACAAGCT
GTAGGTGGTCCACAAAATGATGGTGGTTTGTTAAAAAATGCAAAAGTGCTCTATGATACGACTGAGAAAAGGATT
CGTGTAACAGGTCTGTACCTTGGAACGGATGAAAAAGTTACGTTGACCTACAATGTTCGTTTGAATGATGAGTTTG
TAAGCAATAAATTTTATGATACCAATGGTCGAACAACCTTACATCTTAAGGAAGTGAACAGAACACAGTGCCGG
ACTTCCCGATTCCTAAGATTCGTGATGTGCGGAAGTATCCAGAAATCACAATTTCAAAAGAGAAAAAACTTGGTG
ACATTGAGTTTATTAAGGTCAATAAAAATGATAAAAAACCACTGAGAGGTGCGGTCTTTAGTCTTCAAAAACAAC
ATCCGGATTATCCAGATATTTATGGAGCTATTGATCAAAATGGCACTTATCAAATGTGAGAACAGGTGAAGATG
GTAAGTTGACCTTTAAAAATCTGTCAGATGGGAAATATCGATTATTTGAAAATTTCTGAACCAGCTGGTTATAAACC
CGTTCAAAATAAGCCTATCGTTGCCTTCCAAATAGTAAATGGAGAAGTCAGAGATGTGACTTCAATCGTTCCACAA
GATATACCAGCGGGTTACGAGTTTACGAATGATAAGCACTATATTACCAATGAACCTATTCCTCCAAAGAGAGAA
TATCCTCGAACTGGTGGTATCGGAATGTTGCCATTCTATCTGATAGGTTGCATGATGATGGGAGGAGTTCTATTAT
ACACACGGAAACATCCGTAA 4191.3                                                              (SEQ. ID. NO. 339)
ATGAAATCAATCAACAAATTTTTAACAATGCTTGCTGCCTTATTACTGACAGCGAGTAGCCTGTTTTCAGCTGCAA
CAGTTTTTGCGGCTGGGACGACAACAACATCTGTTACCGTTCATAAACTATTGGCAACAGATGGGGATATGGATA
AAATTGCAAATGGTTAGAAACAGGTAACTATGCTGGTAATAGATGGGGTGTTCTACCTGCAAATGCAAAAGAAA
TTGCCGGTGTTATGTTCGTTTGGACAAATACTAATAATGAAATTATTGATGAAATGGCCAAACTCTAGGGAGTGAA
TATTGATCCACAAACATTTAAACTCTCAGGGGCAATGCCGGCAACTGCAATGAAAAATTAACAGAAGCTGAAGG
AGCTAAATTTAACACGGCAAATTTACCAGCTGCTAAGTATAAAATTTATGAAATTCACAGTTTATCAACTTATGTC
GGTGAAGATGGAGCAACCTTAACAGGTTCTAAAGCAGTTCCAATTGAAATTACCATTGAACGATGTTGTG
GATGCGCATGTGTATCCAAAAAATACAGAAGCAAAGCCAAAAATTGATAAAGATTTCAAAGGTAAAGCAAATCCA
GATACACCACGTGTAGATAAAGATACACCTGTGAACCACCAAGTTGGAGATGTTGTAGAGTACGAAATTGTTACA
AAATTCCAGCACTTGCTAATTATGCAACAGCAAACTGGAGCGATAGAATGACTGAAGGTTTGGCATTCAACAAA
GGTACAGTGAAAGTAACTGTTGATGATGTGCACTTGAAAGTGATTATTGCTCTAACAGAAGTAGCAACTGGTT
TTGATTTGAAATTAACAGATGCTGGTTTAGCTAAAGTGAATGACCAAAACGCTGAAAAAACTGTGAAAATCACTT
ATTCGGCAACATTCAATGACAAAGCAATTGTAGAAGTACCAGAATCTAATGATGTAACATTTAACTATGGTAATA
ATCCAGATCACGGGAATACTCCAAAGCCGAATAAGCCAAATGAAAACGGCGATTTGACATTGACCAAGACATGGG
TTGATGCTACAGGTGCACCAATTCCGGCTGGAGCTGAAGCAACGTTCTGCGATTTGGTTAATGCTCAGATCTGAAAGT
TGTACAAACTGTAACTTTGACAACAGACAAAAATACAGTTACTGTTAACGGATTGGATAAAAATACAGAATATAA
ATTCGTTGAACGTAGTATAAAAGGGTATTCAGCAGATTATCAAGAAATCACTACAGCTGGAGAAATTGCTGTCAA
GAACTGGAAAGACGAAAATCCAAAACCACTTGATCCAACAGAGCCAAAAGTTGTTACATATGGTAAAAAGTTTGT
CAAAGTTAATGATAAAGATAATCGTTTAGCTGGGGCAGAATTTGTAATTGCAAATTGCAAATAATGGCTGGTCAATAT
TTAGCACGTAAAGCAGATAAAGTGAGTCAAGAAGAGAAGCAGTTGGTTGTTACAACAAAGGATGCTTTAGATAGA
GCAGTTGCTGCTTATAACGCTCTTACTGCACAACAACAAACTCAGCAAGAAAAGAGAAAGTTGACAAAGCTCAA
GCTGCTTATAATGCTGCTGTGATTGCTGCCAACAATGCATTTGAATGGGTGGCAGATAAGGACAATGAAAATGTTG
TGAAATTAGTTTCTGATGCACAAGGTCGCTTTGAAATTACAGGCCTTCTTGCAGGTACATATTACTTAGAAGAAAC
AAAACAGCCTGCTGGTTATGCATTACTAACTAGCCGTCAGAAATTTGAAGTCACTGCAACTTCTTATTCAGCGACT
```

TABLE 1-continued

GGACAAGGCATTGAGTATACTGCTGGTTCAGGTAAAGATGACGCTACAAAAGTAGTCAACAAAAAAATCACTATC
CCACAAACGGGTGGTATTGGTACAATTATCTTTGCTGTAGCGGGGGCTGCGATTATGGGTATTGCAGTGTACGCAT
ATGTTAAAAACAACAAAGATGAGGATCAACTTGCTTAA 4191.4 (SEQ. ID. NO. 340)
ATGACAATGCAGAAAATGCAGAAAATGATTAGTCGTATCTTCTTTGTTATGGCTCTGTGTTTTTCTCTTGTATGGG
TGCACATGCAGTCCAAGCGCAAGAAGATCACACGTTGGTCTTGCAATTGGAGAACTATCAGGAGGTGGTTAGTCA
ATTGCCATCTCGTGATGGTCATCGGTTGCAAGTATGGAAGTTGGATGATTCGTATTCCTATGATGATCGGGTGCAA
ATTGTAAGAGACTTGCATTCGTGGGATGAGAATAAACTTTCTTCTTTCAAAAAGACTTCGTTTGAGATGACCTTCC
TTGAGAATCAGATTGAAGTATCTCATATTCCAAATGGTCTTTACTATGTTCGCTCTATTATCCAGACGGATGCGGT
TTCTTATCCAGCTGAATTTCTTTTTGAAATGACAGATCAAACGGTAGAGCCTTTGGTCATTGTAGCGAAAAAAACA
GATACAATGACAACAAAGGTGAAGCTGATAAAGGTGGATCAAGACCACAATCGCTTGGAGGGTGTCGGCTTTAAA
TTGGTATCAGTAGCAAGAGATGTTTCTGAAAAAGAGGTTCCCTTGATTGGAGAATACCGTTACAGTTCTTCTGGTC
AAGTAGGGAGAACTCTCTATACTGATAAAAATGGAGAGATTTTTGTGACAAATCTTCCTCTTGGGAACTATCGTTT
CAAGGAGGTGGAGCCACTGGCAGGCTATGCTGTTACGACGCTGGATACGGATGTCCAGCTGGTAGATCATCAGCT
GGTGACGATTACGGTTGTCAATCAGAAATTACCACGTGGCAATGTTGACTTTATGAAGGTGGATGGTCGGACCAA
TACCTCTCTTCAAGGGGCAATGTTCAAAGTCATGAAAGAAGAAAGCGGACACTATACTCCTGTTCTTCAAAATGGT
AAGGAAGTAGTTGTAACATCAGGGAAAGATGGTCGTTTCCGAGTGGAAGGTCTAGAGTATGGGACATACTATTTA
TGGGAGCTCCAAGCTCCAACTGGTTATGTTCAATTAACATCGCCTGTTTCCTTTACAATCGGGAAAGATACTCGTA
AGGAACTGGTAACAGTGGTTAAAAATAACAAGCGACCACGGATTGATGTGCCAGATACAGGGGAAGAAACCCTTG
TATATCTTGATGCTTGTTGCCATTTTGTTGTTTGGTAG 4191.5 (SEQ. ID. NO. 341)
ATGAGCCACATATACTTATCTATTTTCACAAGTCTCTTGCTGATGCTAGGACTTGTCAATGTTGCTCAAGCCGATG
AATATTTACGCATCGGTATGGAAGCAGCATATGCTCCCTTTAACTGGACCCAGGATGATGATAGCAACGGACCTG
TCAAAATCGATGGGACCAATCAGTATGCCAACGGATACGATGTTCAAATCGCCAAGAAAATCGCTAAGGACTTAG
GTAAAGAACCTTTGGTTGTTAAAACCAAGTGGGAAGGTCTAGTCCCTGCCCTTACTTCTGGTAAGATTGACATGAT
TATCGCAGGTATGAGTCCAACTGCAGAACGCAAACAAGAAATTGCCTTTTCGAGCAGTTACTATACTAGCGAACC
AGTTTTGCTTGTCAAAAAAGATTCTGCCTACGCAAGTGCTAAATCTTTTGGATGACTTTAACGGTGCAAAAATCACT
TCTCAACAAGGGGTCTACCTTTATAACTTGATTGCACAAATCCCAGGTGCTAAAAAAGAAACAGCCATGGGAGAC
TTCACTCAAATGCGACAAGCTCTTGAGGCTGGTGTCATTGATGCTTATGTTTCTGAACGTCCAGAAGCACTGACTG
CTGAAGCTGCGAACTCTAAGTTCAAGATGATTCAAGTAGAACCTGGTTTCAAAACTGGGGAAGAAGATACAGCTA
TCGCTATCGGGCTTCGTAAAAATGACAATCGTATTAGCCAAATCAATGCCAGCATTGAAGCTACAATTTCAAAAGATG
ACCAAGTTGCCTTGATGGATCGTATGATCAAGGAACAACCTGCCGAAGCTACAACAACTGAAGAGACTAGCAGTA
GTTTCTTTAGCCAAGTTGCTAAAATTCTTTCTGAAAACTGGCAACAACTCTTGCGTGGTGCTGGTATCACTCTTTTA
ATCTCTATCGTCGGAACCATCATAGGTCTCATTATTGGACTTGCCATTGGTGTCTTCCGTACTGCTCCTCTCTCTGA
AAACAAAGTCATTTACGGCCTACAAAAACTAGTCGGCTGGGTTCTCAATGTCTACATTGAAATTTTCCGTGGTACG
CCAATGATTGTTCAATCGATGGTTATCTACTATGGAACTGCCCAAGCTTTCGGGATCAACC
TTGACCGTACACTGGCTGCTATCTTCATCGTTTCAATCAATACCGGTGCCTACATGACTGAAATCGTCCGTGGTGG
TATCCTAGCAGTTGACAAGGGACAATTTGAAGCTGCGACTGCTCTTGGTATGACCCATAACCAGACCATGCGTAA
GATTGTCCTACCTCAGGTAGTCCGTAACATCCTACCTGCAACTGGTAATGAATTTGTCATCAATATCAAAGATACA
TCTGTATTGAACGTTATCTCTGTTGTCGAACTTTATTTCTCAGGAAATACCGTGGCAACACAAACCTATCAATACTT
CCAGACATTTACAATCATCGCCGTGATTTACTTTGTCCTCACCTTCACCGTAACACGTATCCTACGCTTTATCGAGC
GCAGAATGGACATGGATACCTACACTACAGGTGCTAACCAAATGCAAACGGAGGATTTGAAATAA 4191.6 (SEQ. ID. NO. 342)
ATGACACAAGCAATCCTTGAAATTAAACACCTCAAAAAATCCTATGGACAAAACGAAGTGCTAAAAGACATTTCA
CTCACTGTCCACAAGGGAGAGGTCATCTCTATCATCGGAAGCTCTGGAAGCGGAAAATCGACCTTCCTACGCTCC
ATTAACCTACTTGAAACACCAACTGATGGACAAATCCTTTATCATGGACAAAACGTCCTCGAAAAAGGCTATGAC
CTCACGCAATACCGTGAAAAGTTGGGGATGGTTTTCCAATCCTTTAACCTCTTTGAAAATCTCAATGTTCTTGAAA
ACACAATCGTCGCTCAGACAACTGTCCTAAAACGCGAACGCACAGAAGCTGAAAAGATTGCCAAAGAAAACCTG
GAAAAGGTCGGCATGGGAGAACGCTACTGGCAAGCCAAACCAAAACAACTCTCAGGTGGTCAAAAACAACGTGT
GGCCATCGCTCGTGCCCTCTCCATGAATCCGGACGCTATTCTCTTTGATGAACAACATCAGCTCTGATCCAGAA
ATGGTTGGAGAAGTCCTCAAAATCATGCAGGACCTGGCTCAGGAAGGCTTGACCATGATTGTCGTAACCCATGAA
ATGGAATTTGCCCGTGATGTCTCTCACCGTGTTATCTTTATGAATAAGGGCGTGATCGCTGAAGAAGGTAAACCAG
AAGACCTCTTCACCAATCCTAAAGAAGACCGAACAAAAGAGTTCCTTCAACGCTATCTCAAATAA 4192.3 (SEQ. ID. NO. 343)
ATGAAAAAGTATCAACTTCTATTCAAAATAAGTGCAGTCTTCTCTTACTTATTTTTCGTATTTAGTCTTTCTCAGCT
GACGCTTATCGTCCAAAACTATTGGCAATTTTCTTCTCAGATAGGCAATTTATTCTGGATTCAAAATATCTTGAGTT
TACTTTTTATTGGAGTCATGATTGTGGTTCTTGTTAAGACAGGCCATGGTTATCTCTTCCGCATTCCAAGAAAAAA
ATGGCTTTGGTATTCGATTTTGACAGTATTAGTGCTAGTGTTCCAGATCTCTTTTAACGTTCAGACAGCTAAACATG
TTCAGTCAACTGCGGAAGGTTGGGCTGTATTGATTGGTTATAGTGGGACTAACTTTGCAGAGCTAGGCTATTTATAT
AGCCCTGTTCTTTCTGGTTCCACTGATGGAAGAATTGATTATAGAGGATTACTGCAACATGCTTTCTTTAAGCATT
CGCGATTTGGTCTTGATTTGCTTCTTCCTTCTATTTTATTTGCTCTCCCTCATTTTTCAAGCCTGCCTAGTCTGTTAG
ATATCTTCGTCTTTGCAACAGTTGGAATCATCTTTGCTGGTTTGACCCGCTATACCAAGAGCATTTATCCATCCTAT
GCGGTGCATGTGATCAATAATATTGTAGCGACCTTCCCGTTTTTGCTCACTTTTCTACATAGGGTCTTGGGGTAA 4193.1 (SEQ. ID. NO. 344)
ATGAACAAGAAACAATGGCTAGGTCTTGGCCTAGTTGCAGTGGCAGCAGTTGGACTTGCTGCATGTGGTAACCGC
TCTTCTCGTAACGCAGCTTCATCTTCTGATGTGAAGACAAAAGCAGCAATCGTCACTGATACTGGTGGTGTTGATG
ACAAATCATTCAACCAATCAGCTTGGGAAGGTTTGCAGGCTTGGGTAAAGAACACAATCTTTCAAAAGATAACG
GTTTCACTTACTTCCAATCAACAAGTGAAGCTGACTACGCTAACAACTTGCAACAAGCGGCTGGAAGTTACAACCT
AATCTTCGGTGTTGGTTTTGCCCTTAATAATGCAGTTAAAGATGCAGCAAAAGAACACACTGCTTGAACTATGTC
TTGATTGATGATGATTAAAGACCAAAAGAATGTTGCGAGCGTAACTTTCGCTGATAATGAGTCAGGTTACCTTG
CAGGTGTGGCTGCAGCAAAAACAACTAAGACAAAACAAGTTGGTTTTGTAGGTGGTATCGAATCTGAAGTTATCT
CTCGTTTTGAAGCAGGATTCAAGGCTGGTGTTGCGTCAGTAGACCCATCTATCAAAGTCCAAGTTGACTACGCTGG
TTCATTTGGTGATGCGGCTAAAGGTAAAACAATTGCAGCCGCACAATACGCAGCCGGTGCAGATATTGTTTACCA
AGTAGCTGGTGGTACAGGTGCAGGTGTCTTTCAGAGGCAAAATCTCTCAACGAAAGCCGTCCTGAAAATGAAAA

TABLE 1-continued

AGTTTGGGTTATCGGTGTTGATCGTGACCAAGAAGCAGAAGGTAAATACACTTCTAAAGATGGCAAAGAATCAAA
CTTTGTTCTTGTATCTACTTTGAAACAAGTTGGTACAACTGTAAAAGATATTTCTAACAAGGCAGAAAGAGGAGAA
TTCCCTGGCGGTCAAGTGATCGTTTACTCATTGAAGGATAAAGGGGTTGACTTGGCAGTAACAAACCTTTCAGAAG
AAGGTAAAAAAGCTGTCGAAGATGCAAAAGCTAAAATCCTTGATGGAAGCGTAAAAGT
TCCTGAAAAATAA 4193.3                                                          (SEQ. ID. NO. 345)
ATGTCTAAAAAATTACAACAAATTTCGGTTCCCTTGATTTCTGTATTCCTAGGAATTTTACTCGGAGCCATTGTCAT
GTGGATCTTCGGTTATGATGCTATTTGGGGCTACGAAGAATTGTTCTATACAGCCTTTGGCAGTCTGCGTGGGATT
GGGAGAAATCTTCCGTGCTATGGGTCCTCTGGTCTTGATTGGTCTTGGTTTTGCCGTTGCCAGTCGAGCTGGTTTCTT
TAACGTCGGACTTCCTGGTCAGGCTTTGGCAGGTTGGATTCTCAGTGGTTGGTTTGCCCTGTCGCATCCAGATATG
CCCCGTCCCTTGATGATTCTAGCAACCATCGTGATTGCCTTGATTGCTGGTGGGATTGTCGGAGCGATTCCAGGTA
TTCTTAGGGCCTATCTAGGGACGTCAGAGGTTATTGTAACCATCATGATGAACTACATTGTCTTGTATGTAGGGAA
TGCCTTTATCCATGCTTTCCCTAAAGACTTCATGCAAAGTACAGATTCGACCATTCGTGTTGGGGCTAATGCAACC
TATCAGACACCTTGGTTGGCTGAGTTGACTGGTAACTCACGGATGAATATTGGTATTTTCTTTGCCATCATTGCCGT
TGCAGTTATTTGGTTCATGCTCAAGAAAACAACTCTTGGTTTTGAAATCCGTGCAGTTGGTCTTAATCCACATGCTT
CAGAATATGCTGGTATTTCTGCCAAGCGGACTATTATCCTATCTATGATTATTTCAGGTGCCTTGGCAGGTCTTGGT
GGAGCTGTTGAAGGTTTGGGAACCTTCCAGAACGTCTATGTTCAAGGTTCGTCATTAGCTATCGGATTTAACGGAA
TGGCGGTTAGTTTGCTTGCGGCCAACTCACCAATTGGTATACTCTTTGCAGCCTTCCTATTTGGCGTTCTCCAAGTT
GGGGCTCCTGGTATGAATGCGGCGCAGGTACCATCTGAGCTTGTCAGCATTGTAACAGCGTCTATTATCTTCTTTG
TCAGTGTTCATTACCTTATCGAACGCTTTGTCAAACCGAAAAAACAAGTTAAAGGAGGTAAGTAA 4194.1                                                          (SEQ. ID. NO. 346)
ATGGGAGTGAAAAAGAAACTAAAGTTGACTAGTTTGCTAGGACTGTCTCTGTTAATCATGACAGCCTGTGCGACT
AATGGGGTAACTAGCGATATTACAGCCGAATCGGCTGATTTTTGGAGTAAATTGGTTTACTTCTTTGCGGAAATCA
TTCGCTTTTTATCGTTTGATATTAGTATCGGAGTGGGGATTATTCTCTTTACGGTCTTGATTCGTACAGTCCTCTTG
CCAGTCTTTCAGGTGCAAATGGTGGCTTCTAGGAAAATGCAGGAAGCTCAGCCACGCATTAAGGCGCTTCGAGAA
CAATATCCAGGTCGAGATATGGAAAGCAGAACCAAACTAGAGCAGGAAATGCGTAAAGTATTTAAAGAAATGGG
TGTCAGACAGTCAGACTCTCTTTGGCCGATTTTGATTCAGATGCCGGTTATTTTGGCCCTGTTCCAAGCCCTATCAA
GAGTTGACTTTTTAAAGACAGGTCATTTCTTATGGATTAACCTTGGTAGTGTGGATACAACCCTTGTTCTTCCGATT
TTAGCAGCAGTATTCACCTTTTTAAGTACTTGGTTGTCCAACAAAGCTTTGTCTGAGCGAAATGGCGCTACGACTG
CGATGATGTATGGGATTCCAGTCTTGATTTTTATCTTTGCAGTTTATGCGCCAGGTGGAGTCGCCCTATACTGGAC
AGTGTCTAATGCTTATCAAGTCTTGCAAACCTATTTCTTGAATAATCCATTCAAGATTATCGCAGAGCGCGAGGCC
GTAGTACAGGCACAAAAAGATTTGGAAAATAGAAAAAGAAAAGCCAAGAAAAAGGCTCAGAAAACGAAATAA 4194.4                                                          (SEQ. ID. NO. 347)
ATGGTTATCGATCCATTTGCTATCAACGAACTAGACTATTACTTAGTTTCACACTTCCACAGTGATCATATCGACC
CATACACAGCTGCAGCAATTCTCAATAATCCTAAGTTAGAGCATGTTAAGTTTATCGGTCCTTACCACTGTGGACG
AATCTGGGAAGGATGGGGTGTTCCAAAAGAACGTATCATCGTTGTTAAACCAGGTGACACTATCGAATTAAAAGA
TATGAAGATTCATGCAGTAGAATCATTTGACCGTACTTGCTTGGTAACTCTCCCAGTGAACGGTGCTGATGAGACA
GGCGGTGAACTTGCTGGCTTGGCTGTTACAGATGAAGAAATGGCTCAAAAGGCTGTTAACTATATCTTTGAAACAC
CAGGTGGAACCATCTATCATGGTGCAGATTCTCACTTCTCAAACTATTTTGCAAAACATGGTAAAGACTTTAAAAT
TGATGTTGCTTTGAATAACTATGGTGAAAATCCGGTAGGTATCCAAGACAAAATGACATCTATCGACCTTCTTCGT
ATGGCAGAAAATCTGCGTACCAAAGTCATTATCCCAGTTCACTATGATATCTGGTCTAACTTCATGGCTTCTACTA
ATGAGATTCTAGAACTTTGGAAAATGCGAAAAGATCGCTTGCAATACGATTTCCATCCATTTATCTGGGAAGTTGG
CGGTAAGTACACTTATCCTCAAGATCAACACTTAGTAGAATACCATCATCCACGTGGTTTTGATGATTGTTTTGAA
CAAGACTCTAACATTCAATTTAAAGCTTTGCTATAA 4196.2                                                          (SEQ. ID. NO. 348)
ATGTTCCTTTCAGGCTGGTTGTCTAGTTTTGCTAATACTTATATCCATGATTTACTGGGGGTTCTTTTCCCAGATAG
TCCATTTTTAAATGCCTTTGAAAGTGCTATTGCGGCTCCTTTGGTAGAAGAACCCTTGAAATTATTGTCACTTGTTT
TTGTTTTGGCTTTGATTCCTGTGCGAAAATTAAAATCTTTGTTTTTACTTGGAATTGCTTCCGGTTTGGGATTCCAA
ATGATTAAGGATATTGGTTATATTCGTACGGATTTGCCAGAGGGCTTTGACTTTACTATTTCGCGAATTTTAGAGC
GTATCATCTCAGGAATTGCCTCTCACTGGACTTTTTCAGGTCTAGCTGTAGTAGGTGTTTACTTGTTTTACAGAGCC
TATAAAGGACAGAAGGTTGGCAAGAAACAGGGCCTTATTTTTCTAGGTTTAGCCTTGGGAACTCACTTCTTGTTTA
ACTCTCCTTTTGTGGAGTTGGAAACAGAGTTGCCTTTAGCGATTCCAGTGGTTACGGCTATTGCTCTCTATGGTTTT
TATCATGCTTATTGCTTTGTTGAGAAACACAATGAGTTGATGACCTAG 4197.1                                                          (SEQ. ID. NO. 349)
ATGAAGGTGGAACCACGTTGCCGACGTCCTTTCGAGGATGTCGCATTTTTTTATTAGGATACTAATTATGGAGTTGC
AAGAATTAGTGGAGCGCAGTTGGGCAATCCGACAAGCTTATCACGAACTGGAAGTTAAGCATCATGATTCCAAGT
GGACGGTAGAAGAAGACCTCTTGGCTTTATCTAATGATATTGGAAATTTCCAAGACTGGTGATGACAAAGCAAG
GACGCTACTATGATGAAACACCCTACACACTGGAACAAAAACTTTCAGAAAATATCTGGTGGCTATTAGAACTTT
CTCAACGTTTGGATATAGACATTCTGACGGAAATGGAAAACTTCCTCTCTGATAAAGAAAAGCAATTGAACGTTA
GGACTTGGAAGTAG 4197.4                                                          (SEQ. ID. NO. 350)
ATGCTTGATTGGAAACAATTTTTTCTAGCCTATCTGCGCTCCCGTAGTCGTCTTTTTATCTATCTGCTTTCTTTGGC
ATTTCTTGTCTTACTCTTTCAGTTTTTATTTGCCAGTCTAGGAATTTACTTCCTCTACTTTTTCTTCTTGTGTTGCTTT
GTAACCATATTATTTTTCACTTGGGACATATTGGTGGAAACGCAGGTCTATCGCCAGGAACTTCTCTATGGAGAGA
GGGAAGCCAAGTCTCCTTTGGAAATAGCTTTAGCAGAAAAATTAGAAGCGCGTGAGATGAACTCTATCAGCAGA
GGTCAAAAGCAGAAAGAAAACTGACGGATTTGCTGGATTACTATACCTTGTGGGTCCATCAGATAAAGACCCCCA
TTGCAGCCAGTCAACTCTTAGTTGCAGAAGTGGTCGACCGCCAACTGAAGCAGCAGCTAGAACAGGAAATTTTCA
AAATCGACTCCTATACCAACCTAGTTTTACAGTACCTGCGTTTAGAAAGTTTCCATGATGATTTGGTCTTAAAGCA
GGTTCAAATTGAGGACTTGGTCAAGGAAATAATTCGTAAATATGCTCTTTTCTTTATTCAAAAAGGCTTAAATGTC
AATCTACATGACCTTGATAAAGAAATCGTGACGGATAAAAAGTGGCTGCTAGTGGTTATTGAGCAAATCATCTCA
AACAGTCTCAAGTACACCAAGGAAGGTGGTCTGGAGATTTATATGGATGACCAAGAGCTTTGTATCAAAGATACG
GGAATCGGGATAAAAAACAGTGATGTCCTCCGAGTATTTGAACGTGGCTTTTCAGGATACAATGGCCGTTTGACCC

TABLE 1-continued

AGCAGTCCTCTGGACTTGGCCTTTATCTATCTAAGAAAATTTCTGAAGAACTGGGGCACCAGATTCGTATCGAGTC
TGAGGTCGGAAAAGGAACGACAGTGCGGATTCAGTTTGCTCAAGTGAACTTAGTCCTTGAGTAA 4211.2                                                              (SEQ. ID. NO. 351)
ATGGAACTTAATACACACAATGCTGAAATCTTGCTCAGTGCAGCTAATAAGTCCCACTATCCGCAGGATGAACTG
CCAGAGATTGCCCTAGCAGGGCGTTCAAATGTTGGTAAATCCAGCTTTATCAACACTATGTTGAACCGTAAGAATC
TCGCCCGTACATCAGGAAAACCTGGTAAAACCCAGCTCCTGAACTTTTTTAACATTGATGACAAGATGCGCTTTGT
GGATGTGCCTGGTTATGGCTATGCTCGTGTTTCTAAAAAGGAACGTGAAAAGTGGGGGTGCATGATTGAGGAGTA
CTTAACGACTCGGGAAAATCTCCGTGCGGTTGTCAGTCTAGTTGACCTTCGTCATGACCCGTCAGCAGATGATGTG
CAGATGTACGAATTTCTCAAGTATTATGAGATTCCAGTCATCATTGTGGCGACCAAGGCGGACAAGATTCCTCGTG
GTAAATGGAACAAGCATGAATCAGCAATCAAAAAGAAATTAAACTTTGACCCGAGTGACGATTTCATCCTCTTTTC
ATCTGTCAGTAAGGCAGGGATGGATGAGGCTTGGGATGCAATCTTAGAAAAATTGTGA 4211.3                                                              (SEQ. ID. NO. 352)
ATGACAAAGAAACAACTTCACTTGGTGATTGTGACAGGGATGAGTGGCGCAGGGAAAACTGTAGCCATTCAGTCC
TTCGAGGATCTAGGTTATTTCACCATTGATAATATGCCGCCAGCTCTCTTGCCTAAGTTTTTGCAGCTGGTTGAAAT
TAAGGAAGACAATCCTAAGTTGGCCTTGGTAGTGGATATGCGTAGCCGTTCTTTCTTTTCAGAGATTCAAGCTGTT
TTGGATGAGTTGGAAAATCAAGATGGTTTGGATTTCAAAATCCTCTTTTTGGATGCGGCTGATAAGGAATTCCTCG
CTCGTTACAAGGAAACCAGACGGAGTCACCCACTAGCAGCAGACGGTCGTATTTTAGATGGAATCAAGTTGGAAC
GTGAACTCTTGGCCACCTTTGAAAAATATGAGCCAAAATGTGGTGGATACGACTGAACTCACTCCACGTGAGCTGCG
CAAAACCCTTGCAGAGCAGTTTTCAGACCAAGAACAAGCCCAGTCTTTCCGTATCGAAGTCATGTCTTTCGGATTT
AAGTATGGAATCCCGATTGATGCGGACTTGGTCTTTGATGTCCGTTCTTGCCAAATCCCTATTATTTACCAGAACT
GAGAAACCAAACGGGTGTGGATGAACCTGTTTATGATTATGTCATGAACCATCCTGAGTCAGAAGACTTTTATCAA
CATTTATTGGCCTTGATTGAGCCGATTCTGCCAAGTTACCAAAAGGAAGGTAAGTCCGTTTTGACCATTGCCATGG
GATGTACGGGTGGACAACACCGTAGTGTGGCATTTGCTAAACGCTTGGCGCAGGACTTATCCAAGAATTGGTCTGT
TAATGAAGGGCATCGCGACAAAGACCGCAGAAAGGAAACGGTAAACCGTTCATGA 4211.4                                                              (SEQ. ID. NO. 353)
ATGAGAAAACCAAAGATAACGGTGATTGGTGGAGGGACTGGAAGTCCCGTCATTCTAAAAAGTCTGCGGGAAAAA
GATGTGGAAATCGCAGCTATCGTGACGGTGGCAGATGATGGTGGTTCTTCAGGTGAACTCCGAAAAAATATGCAA
CAGTTGACACCGCCAGGTGATCTTCGTAATGTCCTTGTGGCCATGTCGGATATGCCTAAGTTTTATGAGAAGGTCT
TTCAGTATCGGTTCTCTGAGGATGCCGGAGCCTTTGCTGGCCATCCATTGGGAAATCTCATCATTGCTGGCTTGTC
AGAAATGCAGGGTTCAACCTATAATGCCATGCAGTTATTGACCAAATTTTTCCATACAACAGGGAAAATTTATCCT
TCCAGTGACCATCCTTTGACCCTTCATGCAGTCTTTCAGGATGGGACAGAAGTGGCTGGAGAGAGTCATATTGTAG
ACCATCGAGGCATAATTGACAATGTCTATGTGACCAATGCCCTAAACGATGATACGCCTCTGGCCAGCCGTCGAG
TAGTGCAGACCATCCTTGAAAGTGACATGATTGTCCTAGGGCCAGGTTCCCTCTTTACCTCTATTTTGCCCAATAT
CGTGATTAAGGAAATTGGGCGGGCTCTTTTGGAAACCAAGGCAGAAATTGCCTATGTCTGCAATATCATGACCCA
ACGTGGGGAGACGGAACACTTTACAGATAGCGACCACGTGGAAGTCTTGCATCGTCACCTTGGTCGCCCTTTTATC
GACACTGTCTTGGTGAATATTGAAAAAGTGCCTCAGGAATACATGAATTCCAACCGTTTTGATGAATACTTAGTGC
AAGTGGAACACGATTTTGTAGGTCTTTGTAAGCAAGTTTCGCGCGTGATTTCATCTAACTTCCTTCGTCTGGAAAA
TGGCGGTGCCTTCCACGATGGAGATTTGATTGTGGACGAGTTGATGCGCATTATACAGGTGAAAAAATGA 4213.1                                                              (SEQ. ID. NO. 354)
ATGAAAAAATTTGATAAAGTTGCTAATAATTAGATTGATTGTTAACTTAGCAGACAGTGTATTTTATATAGTAGCAT
TGTGGCACGTTAGCAATAATTATTCTTCGAGCATGTTCTTAGGAATATTTATTGCAGTAAATTATCTACCGGATTTG
TTACTAATCTTTTTTGGACCAGTTATTGACAGAGTAAATCCGCAAAAAATTCTTATAATATCAATTTTGGTTCAATT
AGCAGTGGCTGTAATATTTTTATTATTATTAAACCAAATATCATTTTGGGTGATAATGAGTCTAGTGTTTATTTCAG
TAATGGCTAGCTCCATAAGTTACGTGATAGAAGATGTGTTGATTCCTCAAGTGGTAGAATATGATAAGATTGTATT
TGCAAATTCTCTTTTTAGTATTTCGTATAAAGTATTAGATTCTATTTTTAATTCATTCGCATCATTTTTACAGGTGG
CAGTAGGATTTATTTTATTGGTTAAGATAGATATAGGCATATTTTTACTTGCTCTATTTATATTGTTGTTGTTAAAA
TTTAGAACTAGCAATGCGAATATAGAAAACTTCTCTTTCAAATATTACAAGAGAAGTGTTGCAAGGTACAAAG
TTTATTTTAAATAATAAATTATTATTTAAAACCAGTATTTCTTTAACGCTTATAAACTTTTTATTCATTTCAGACA
GTAGTTGTACCGATTTTTTCTATTCGATATTTTGATGGTCCGATTTTTTATGGTATTTTTTAACTATTGCTGGTTTG
GGTGGTATATTGGGAAATATGCTAGCGCCAATCGTAATAAAATATTTAAAATCGAATCAAATTGTTGCTATTTC
TTTTTTTGAACGGCTCAAGTTGGTTAGTAGCAATTCTTATAAAAGACTATACTTTATCACTTATTTATTTTTCGTTT
GTTTTATGTCTAAAGGAGTCTTCAATATTATTTTTAATTCGTTGTACCAACAAATACCTCCACATCAACTTCTTGGT
AGGGTAAATACTACCATTGATTCTATTATTTCTTTTGGAATGCCAATTGGTAGTTTAGTTGCAGGAACGCTTATTGA
TTTGAATATTGAATTAGTGTTAATTGCTATTAGCATACCTTATTTTTTGTTTTCTTATATTTTTATACGGATAATGG
ATTGAAAGAATTTAGTATATATTAG 4213.2                                                              (SEQ. ID. NO. 355)
ATGATGTCTAACAAAAATAAGGAAATTCTGATTTTTGCGATTCTCTATACAGTCCTCTTTATGTTTGATGGCGTTAA
ATTGCTGGCTTCTTTAATGCCATCTGCCATTGCAAATTATCTTGTTTATGTAGTTTTAGCTCTATATGGCTCCTTCTT
GTTCAAGGATAGATTGATCCAACAATGGAAGGAGATTAGAAAGACTAAAAGAAAATTCTTCTTTGGAGTCTTAAC
AGGATGGCTCTTTCTCATTCTGATGACTGTTGTCTTTGAATTTGTATCAGAGATGTTGAAGCAGTTTGTGGGACTAG
ATGGACAAGGTCTAAATCAGTCTAATATTCAAAGTACCTTTCAAGAACAACCACTACTGATAGCTGTTTTTGCTTG
TGTCATTGGACCTCTGGTAGAAGAATTATTTTTCCGTCAGGTCTTATTGCATTACTTGCAGGAACGGTTGTCAGGTT
TACTAAGCATTATTCTGGTAGGACTTGTTTTTGCTCTGACTCATATGCACAGTTTGGCTCTATCAGAGTGGATTGT
GCAGTTGGTTACTTAGGTGGAGGCCTTGCCTTTTCTATTATTTATGTGAAAGAAAAAGAGAATATCTACTATCCCC
TACTTGTTCACATGTTAAGCAACAGCCTCTCCTTAATCATTTTAGCTATCAGTATAGTAAAATGA 4224.1                                                              (SEQ. ID. NO. 356)
TTGAAAAAGCCAATTATCGAATTCAAAACGTCTCTAAAGTTTTTGAAGACAGCAACACCAAGGTTCTCAAAGAC
ATCACTTTGAGTTGGAAGAAGGGAAATTCTACACCCTTCTAGGTGCATCTGGTTCGGGGAAATCAACTATCCTAA
ACATTATTGCAGGTTTACTGGATGCGACGACAGGAGATATCATGCTAGACGGTGTTCGTATCAATGATATTCCAAC
CAACAAGCGCGACGTACATACCGTCTTCCAATCCTATGCCTTGTTCCCACATATGAATGTGTTTGAAAATGTTGCC
TTTCCACTTCGCTTGCGTAAAATTGATAAGAAAGAAATCGAGCAGCGTGTAGCGGAAGTTCTCAAGATGGTTCAGT
TGGAAGGTTATGAAAAACGTTCCATCCGCAAACTTTCTGGAGGACAACGTCAGCGTGTGGCCATCGCCCGTGCTA
TCATCAACCAACCCCGTGTGGTCTTGTTGGACGAGCCTTTATCAGCGCTGGACTTGAAATTGAGAACAGACATGCA

TABLE 1-continued

```
GTACGAATTGCGTGAATTACAACAACGATTGGGCATTACCTTTGTCTTTGTCACTCACGATCAGGAAGAAGCTCTT
GCCATGAGTGACTGGATTTTCGTTATGAATGATGGCGAGATTGTCCAGTCTGGAACCCCTGTGGACATCTACGATG
AGCCAATCAACCACTTTGTTGCCACCTTTATCGGGGAGTCAAACATCTTGCCAGGTACCATGATTGAGGACTACTT
GGTCGAATTTAACGGCAAACGCTTTGAAGCGGTTGATGGTGGGATGAAGCCAAATGAACCTGTTGAGGTCGTTAT
TCGTCCAGAGGACTTGCGCATTACCCTTCCTGAAGAAGGCAAGCTCCAAGTTAAGGTCGATACCCAGCTTTTCCGT
GGAGTTCATTATGAAATTATCGCCTATGACGAACTTGGAAATGAATGGATGATCCACTCAACCCGTAAGGCTATCG
TGGGTGAGGAAATCGGTCTGGACTTTGAACCAGAAGACATCCACATCATGCGTCTCAATGAAACCGAAGAAGAGT
TCGATGCTCGTATTGAGGAGTACGTAGAAATCGAAGAGCAAGAAGCAGGTTTGATCAATGCAATCGAGGAGGAAA
GAGATGAAGAAAACAAGCTCTAA 4252.1                                                                   (SEQ. ID. NO. 357)
ATGAAATCAATGAGAATCTTATTTTTGTTAGCTTTAATTCAAATCAGTTTGAGTAGCTGTTTCCTATGGAAGGAAT
GCATCTTGTCCTTTAAACAAAGTACAGCTTTTTTCATCGGAAGCATGGTTTTCGTTTCAGGAATCTGTGCTGGAGT
AAATTATCTTTATACCCGTAAGCAAGAAGTCCATAGTGTCCTAGCCAGTAAGAAGTCGGTGAAGCTTTTTTACAGT
ATGTTACTCTTAATTAATTTGTTAGGAGCTGTTCTTGTTTTGTCAGATAACTTGTTCATCAAAAATACGCTGCAGCA
AGAATTAGTTGACTTTTTATTGCCATCCTTCTTTTTCCTATTTGGGCTAGATTTGCTGATTTTTTTACCCTTGAAAAA
ATACGTGCGCGATTTTCTTGCTATGCTGGACAGAAAAAAGACAGTGTTGGTGACTATTTTAGCAACACTTCTTTTC
TTAAGAAATCCAATGACCATTGTCTCACTTCTGATTTATATTGGACTGGGCTTGTTTTTTGCAGCCTATCTTGTCCC
AAAATTCGGTTAAGAAGGAAGTTTCCTTTTTATGGTCATATTTTCCGAGATCTTGTATTGGTCATTGTTACGCTCATTT
TCTTTTAG 4252.2                                                                   (SEQ. ID. NO. 358)
ATGGTTAAAAAAATTATTGGAATGGTGCTAGCTTTACTTTCTGTAACTGTAGTAGGAGTAGGTGTTTTTGCTTATAC
TATTTATCAACAAGGGACAGAAACCTTAGCTAAAACCTATAAAAAGAATTCGGTGAAGAACCAAGGTTATTGAAGC
GACTGAACCTCTAACCATTCTGTTAATGGGAGTGGACACCGGAAATGTTGAACGAACTGAAACTTGGGTCGGTAG
AAGTGATAGCATGATCTTGATGACAGTGAATCCTAAAACGAAAAAAACAACAATGATGAGTTTAGAGCGGGATAT
TCGACGCGCATTGAATCAGGGAATGGTCAGGCTCATGAAGCGAAACTGAACTCAGCATATGCAGATGGTGGAGC
AGAGCTTGCTATAGAAACCATTCAAAAAATGATGAATATCCATATTGATCGCTATGTGATGGTCAATATGAGAGG
ATTGCAAAAACTAGTGGATGCAGTAGGAGGTATTACAGTCAATAATATCCTAGGTTTCCCAATTTCTATCAGTGAC
CAAGAAGAATTTAATACTATTTCTATCGGTGTTGGGGAGCAACATATTGGGGGAGAAGAAGCCCTAGTCTATGCA
CGAATGCGTTACCAAGATCCTGAGGGGATTATGGTCGTCAAAAACGTCAACGTGAAGTTATTCAAAAAGTCATG
GAAAAAGCTCTCAGTTTAAATAGCATTGGTCATTATCAAGAGATTCTAAAAGCTTTGAGTGACAATATGCAGACC
AATATTGATTTGTCTGCAAAAAGTATCCCTAACTTGCTAGGCTATAAAGATTCATTTAAAACCATTGAAACTCAGC
AGTTGCAGGGTGAAGGAGAGATACTTCAAGGTGTTTCTTACCAGATTGTTTCGAGAGCACATATGTTGGAAATGCA
AAATCTACTCCGACGTTCTTTGGGACAAGAAGAAGTTACTCAGCTTGAAACCAATGCGGTTTTATTTGAAGATTTA
TTTGGCAGAGCACCTGTTGGTGATGAAGATAATTAA 4256.2                                                                   (SEQ. ID. NO. 359)
ATGAAAAAACAAGCCTATGTCATTATTGCTCTCACCTCCTTCCTATTTGTCTTTTTTTTCTCCCACAGCTTGCTGGA
AATACTTGATTTTGACTGGTCTATCTTTTTGCACGATGTCGAAAAAACAGAAAAATTTGTCTTTTTATTGTTGGTTT
TCAGCATGTCCATGACCTGTCTCTTAGCCCTGTTTTGGCAGGGAGTTTCTCTAAGAAAAATGCAGGC
TAATCTCAAGCGTTTATTAGCAGGGCAAGAAGTGGTTCAGGTTGCAGATCCAGATTTGGATGCCAGTTTCAAGTCC
TTATCAGGTAAACTTAACCTTTTGACAGAGGCTCTTCAAAAAGCTGAAAATCAGAGCCTTGCTCAGGAAGAGGAA
ATCATCGAGAAGGAACGGAAGCGAATTGCTCGGGATTTGCACGATACAGTCAGTCAGGAGTTGTTTGCGGCCCAC
ATGATTTTATCGGGTATCAGTCAGCAGGCTTTGAAATTGGATAGAGAAAAGATGCAGACCCAGTTGCAGAGTGTC
ACAGCTATTTTAGAAACAGCCCAGAAGGATTTGCGGGTTTTGCTCTTGCATTTGCGACCAGTTGAACTGGAGCAGA
AGAGCTTGATAGAAGGGATTCAAATTCTTTTAAAAGAGCTTGAGGACAAGAGTGATCTTAGGGTTAGTCTCAAGC
AGAATATGACGAAATTGCCTAAGAAAATCGAGGAGCATATCTTCCGTATCCTGCAAGAGTTGATTAGCAATACCC
TCCGCCATGCCCAGGCATCTTGCCTAGATGTCTACCTCTATCAGACAGATGTTGAATTGCAACTGAAGGTGGTGGA
CAATGGGATTGGTTTCCAGTTAGGGAGCTTAGACGACTTGAGTTATGGACTGCGAAATATCAAGGAGCGGGTTGA
AGATATGGCTGGAACAGTTCAACTCTTGACAGCTCCCAAGCAAGGGCTGGCGGTTGATATCCGTATTCCCCTGTTA
GATAAGGAATGA 4263.1                                                                   (SEQ. ID. NO. 360)
ATGATTGTTTCCATTATTTCTCAAGGATTTGTCTGGGCTATTCTAGGTCTGGGAATCTTTATGACATTTAGGATTTT
AAACTTTCCAGATATGACGACAGAAGGTTCCTTCCCTCTTGGGGGAGCTGTTGCTGTCACTTTGATAACAAAGGC
GTGAACCCATTTTTAGCGACACTTGTTGCTGTAGGAGCAGGTTGTTTGGCTGGAATGGCAGCAGGCCTTCTTTATA
CAAAAGGGAAGATCCCAACCTTGCTCTCAGGGATTTTGGTGATGACTTCTTGTCACTCAATCATGCTCTTGATTAT
GGGACGTGCGAATTTAGGCCTGCTTGGAACCAAGCAAATTCAGGATGTTTTGCCTTTTGATTCGGATTTGAATCAA
CTCTTGACAGGTCTCATCTTTGTGAGTATTGTTATTGCTCTCATGCTCTTTTTCTTGGACACTAAACTCGGACAAGC
CTATATTGCTACAGGGGATAATCCTGATATGGCTAGAAGTTTCGGGATTCATACTGGACGCATGGAGCTCATGGGC
TTGGTCTTATCAAATGGTGTGATTGCCCTTGCAGGTGCCCTCATTGCTCAGCAAGAAGGTTATGCCGATGTGTCTC
GAGGGGATCGGGGTTATCGTTGTGGGGCTTGCAAGTTTGATTATTGGAGAAGTTATTTTCAAGAGTTTGAGCTTGC
AGAGCGTTTGGTTACTATCGTTGTAGGTTCTATCGCTTATCAATTTTAGTGTGGGCAGTTATCGCACTTGGCTTTA
ATACAAGTTACCTTCGTTTATACAGTGCCTTGATTTTAGCAGTCTGCCTCATGATTCCAACATTTAAGCAAACAAT
CTTGAAAGGAGCCAAGTTAAGCAAATGA 4346.1                                                                   (SEQ. ID. NO. 361)
ATGAAAAAAATGAAAGTTTGGTCTACTGTACTTGCAACGGGAGTTGCTCTTACTACACTTGCTGCTTGCTCTGGAG
GTTCAAATTCTACGACTGCTTCTTCATCTGAAGAAAAAGCTGATAAAAGTCAAGAATTAGTTATCTATTCGAACTC
AGTCTCAAATGGTCGTGGTGATTGGTTAACTGCTAAAGCAAAAGAAGCTGGTTTTAATATAAAAATGGTTGATATC
GCTGGCGCTCAATTAGCAGACCGTGTTATTGCTGAGAAGAATAATGCAGTTGCAGATATGGTATTTGGAATTGGTG
CTGTTGATTCAAATAAAATTAGAGATCAAAAATTACTAGTACAGTACAAGCCTAAATGGTTAGATAAAATTGATC
AATCTTTATCAGATAAAGATAATTATTATAATCCTGTGATTGTTCAACCATTAGTTTTAATTGGGGCGCCTGATGTA
AAAGAAATGCCTAAAGATTGGACTGAATTAGGTAGTAAGTATAAAGGTAAATATTCAATTTCTGGTCTTCAAGGA
GGTACAGGACGGGCAATTCTAGCAAGTATCTTAGTTCGATACCTTGATGATAAAGGTGAATTAGGTGTTTCCGAAA
AAGGTTGGGAAGTAGCAAAAGAATATTTGAAAAATGCATACACTCTTCAAAAGGGAGAAAGTTCAATTGTTAAGA
TGTTAGACAAAGAAGATCCAATACAATATGGAATGATGTGGGGTTCTGGTGCATTAGTTGGACAAAAAGAACAAA
ATGTTGTTTTCAAAGTTATGACTCCTGAGATTGGTGTACCATTTGTAACTGAACAAACTATGGTTTTAAGCACTAG
```

TABLE 1-continued

```
TAAAAAACAAGCGTTAGCTAAAGAATTTATTGATTGGTTTGGTCAATCAGAAATTCAAGTAGAATATAGTAAGAA
CTTTGGATCTATTCCTGCAAATAAAGATGCCCTCAAAGATCTACCTGAAGATACGAAGAAATTTGTTGATCAAGTG
AAACCACAAAATATTGACTGGGAAGCTGTTGGAAAGCATTTGGATGAATGGGTAGAAAAAGCTGAATTAGAATAC
GTACAATAA
```

4346.2                                                              (SEQ. ID. NO. 362)
```
ATGATTAAATTTGATAATATTCAAATTAAATATGGTGATTTTGTTGCAATTGATAATCTGAATTTAGATATACATG
AAGGGGAATTTTTTACATTTCTTGGGCCTTCAGGATGTGGTAAATCAACTACTTTGAGAGCATTGGTAGGTTTTCT
AGATCCATCATCAGGAAGTATTGAAGTTAATGGAACAGATGTCACTCATTTGGAACCTGAAAAGCGTGGAATTGG
TATTGTATTTCAATCTTATGCGCTATTTCCAACTATGACTGTTTTTGATAATATTGCATTTGGTTTAAAGTTAAGA
AGGTAGCTCCAGATGTTATTAAAGCTAAAGTATCAGCAGTGGCAGCAAAAATTAAGATCTCTGATCAACAGTTAC
AGCGTAATGTATCAGAATTATCTGGGGGTCAACAACAAAGGGTAGCATTGGCTCGTGCTCTGGTTCTTGAACCTAA
AATTCTTTGTCTAGATGAACCATTGTCAAACCTTGACGCAAAATTACGTGTAGATTTGAGAAAAGAGTTGAAAAGA
CTTCAAAAGAGTTAGGTATTACTACTTTATATGTTACTCATGATCAAGAGGAAGCCTTGACTTTATCTGATAGAA
TTGCAGTCTTTAACAATGGATACATCGAACAGGTCGGTACACCAGTAGAGATTTATCATAATTCTCAAACTGAATT
TGTATGTGATTTTATTGGAGATATTAATGTTTTGACCGATGAAACAGTCCACGAAGTATTATTGAAAAATACAAGC
GTTTTCTTAGAGGATAAAAAAGGATACATTCGATTAGAGAAAGTTCGATTCAATCGTGAAACTGAACAAGATTTTA
TTCTAAAAGGGACAATTATTGATGTTGAGTTTTCTGGAGTTACAATTCACTATACAATAAAAGTTTCTGAAAGTCA
GATTCTTAATGTAACAAGTATTGATAGTCAGGCTGCTATTAGATCTGTCGGAGAAAGTGTGGAATTATTTATCACA
CCATCAGACGTTCTGCAATTTTAA
```

4346.3                                                              (SEQ. ID. NO. 363)
```
ATGCGTCATAAATTAAATTTAAAAGATTGGCTTATTCGTTTAGGGTTAATCTGGTTCTTAGTAACATTTATTATTTA
TCCAAACTTTGATCTAGTAGTGAATGTATTTGTAAAAGGAGGAGAATTTTCCCTTGATGCTGTACATCGTGTTCTA
AAATCTCAGAGGGCACTTCAGAGTATTATGAACAGTTTTAAGTTAGCATTTTCACTCATTATTACAGTTAATGTCG
TAGGTATTCTTTGTGTTCTATTTACAGAGTACTTTGATATTAAAGGTGCTAAAATTTTAAAATTAGGTTATATGACC
TCTTTAATTTATGGAGGAGTGGTTTTAGCGACTGGATATAAATTTGTCTATGGTCCTTATGGATTGATTACAAAATT
TTTACAAAATGTTATCCCTTCTTTAGACCCTAACTGGTTTATTGGGTATGGTGCAGTCTTATTCATTATGACATTTT
CAGGAACTGCTAATCATACATTGTTTTTAACAAATACAATTCGAAGCTGTGACTATCACACTATTGAGGCTGCTCG
AAATATGGGAGCAAAACCATTTACTGTTTTCCGAAAAGTAGTGTTACCAACCTTAATTCCAACTCTATTTGCACTT
ACTATTATGGTTTTCTTAGTGGTTTATCTGCAGTAGCAGCACCCATGATTGTTGGTGGTAAAGAATTTCAAACTAT
AAATCCAATGATTATTACATTTGCAGGGATGGGGAATTCTCGTGATTTAGCTGCCCTACTTGCAATTATTTTAGGT
ATTGCAACTACAATTTTGCTTACTATCATGAATAAGATAGAAAAAGGTGGAAATTTATATTTCTATCTCTAAGACTA
AAGCGCCTCTTAAAAAACAAAAAATTGCGTCTAAGCCTTGGAATATCATTGCTCACATTGTAGCATATGGATTGTT
CACAGTTTTCATGCTTCCACTAATTTTTATAGTATTATACTCATTTACAGATCCAGTTGCAATTCAAACAGGTAACT
TAACATTATCAAACTTTACTTTAGAAAATTATCGCTTATTCTTTAGTAATAGTGCGGCATTCTCTCCATTCTTGGTC
AGCTTTATTTATTCTATTATTGCTGCGACAACAGCAACAATTCTCGCAGTTGTATTTGCTCGTGTTGTCAGAAAACA
TAAATCTCGTTTTGATTTCTTATTTGAATATGGTGCTCTACTTCCTTGGTTTACTACCAAGTACACTTTTAGCAGTAA
GTTTATTATTTACTTTTAATCAGCCACAATTTCTTGTCTTGAATCAGATTTTGGTAGGTAGTTTGGTAATTCTACTT
ATTGCATATATAGTTGTAAAAATCCCATTTTCTTATAGAATGGTACGTGCTATTTTATTTAGTGTTGATGATGAGAT
GGAAGATGCAGCAAGAAGTATGGGTGCTTCACCTTTTTATACTATGATGAAGGTTATCATTCCATTTATTTTACCG
GTTGTTCTCTCTGTTATTGCTTTAAACTTTAACTCTTTATTAACTGACTTCGACTTATCTGTATTCCTTTACCATCCC
CTAGCTCAACCATTAGGTATTACGATTCGATCTGCAGGTGATGAAACAGCAACATCTAATGCACAAGCTCTGGTAT
TTGTTTATACAATTGTTCTGATGATTATTTCTGGAACGGTATTATACTTCACACAAAGACCGGGCGTAAAGTAAG
GAAATAA
```

TABLE 2

(SEQ ID. NO. 1)
MEELVTLDCLFIDRTKIEANANKYSFVWKKTTEKFSAKLQEQIQVYFQEEITPLLIKYAMFDKKQKRGYKESAKNLANW

HYNDKEDSYTHPDGWYYRFHHTKYQKTQTDFQQEIKVYYADEPESAPQKGLYMNERYQNLKAKECQALLSPQGRQIF

AQRKIDVEPVFGQIKASLGYKRCNLRGKRQVRIDMGLVLMANNLLKYSKMKZ (SEQ ID. NO. 2)
MGKGHWNRKRVYSIRKFAVGACSVMIGTCAVLLGGNIAGESVVYADETLITHTAEKPKEEKMIVEEKADKALETKNIV

ERTEQSEPSSTEAIASEKKEDSAVTPKEEKVSAKPEEKAPRIESQASNQEKPLKEDAKAVTNEEVNQMIEDRKVDFNQN

WYFKLNANSKEAKPDADVSTWKKLDLPYDWSIFNDFDHESPAQNEGGQLNGGEAWYRKTFKLDEICDLKKNVRLTF

DGVYMDSQVYVNGQLVGHYPNGYNQFSYDITKYLQKDGRENVIAVHAVNKQPSSRWYSGSGIYRDVTLQVTDKVHV

EKNGTTILTPKLEEQQHGKVETHVTSKIVNTDDKDHELVAEYQIVERGGHAVTGLVRTASRTLKAHESTSLDAILEVER

PKLWTVLNDKPALYELITRVYRDGQLVDAKKDLFGYRYYHWTPNEGFSLNGERIKFHGVSLHHDHGALGAEENYKAE

YRRLKQMKEMGVNSIRTTHNPASEQTLQIAAELGLLVQEEAFDTWYGGKKPYDYGRFFEKDATHPEARKGEKWSDFD

LRTMVERGKNNPAIFMWSIGNEIGEANGDAHSLATVKRLVKVIKDVDKTRYVTMGADKFRFGNGSGGHEKIADELDA

VGFNYSEDNYKALRAKHPKWLIYGSETSSATRTRGSYYRPERELKHSNGPERNYEQSDYGNDRVGWGKTATASWTFD

RDNAGYAGQRWTGTDYIGEPTPWHNQNQTPVKSSYFGIVDTAGIPKHDFYLYQSQWVSVKKKPMVHLLPHWNWENK

TABLE 2-continued

ELASKVADSEGKIPVRAYSNASSVELFLNGKSLGLKTFNKKQTSDORTYQEGANANELYLEWKVAYQPGTLEAIARDES

GKEIARDKITTAGKPAAVRLIKEDHAIAADGKDLTYIYYEIVDSQGNVVPTANNLVRPQLHGQGQLVQVDNGEQASRER

YKAQADGSWIRKAFNGKGVAIVKSTEQAGKFTLTAHSDLLKSNQVTVFTGKKEGQEKTVLGTEVPKVQTIIGEAPEMPT

TVPFVYSDGSRAERPVTWSSVDVSKPGIVTVKGMADGREVEARVEVIALKSELPVVKRIAPNTDLNSVDKSVSYVLIDGS

VEEYEVDKWEIAEEDKAKLAIPGSRIQATGYLEGQPIHATLVVEEGNPAAPAVPTVTVGGEAVTGLTSQKPMQYPXLA

YGAKLPEVTASAKNAAVTVLQASAANGMRASIIIQPKDGGPLQTYAIQFLEEAPKIAHLSLQVEKADSLKEDQTVKLSV

RAHYQDGTQAVLPADKVTFSTSGEGEVAIRKGMLELHKPGAVTLNAEYEGAKDQVELTIQANTEKKIAQSIRPVNVVT

DLHQEPSLPATVTVEYDKGFPKTHKVTWQAIPKEKLDSYQTFEVLGKVEGIDLEARAKVSVEGIVSVEEVSVTTPIAEAP

QLPESVRTYDSNGHVSSAKVAWDAIRPEQYAKEGVVVNGRLEGTQLTTKLHVRVSAQTEQGANISDQWTGSELPLAF

ASDSNPSDPVSNVNDKLISYNNQPANRWTNWNRTNPEASVGVLFGDSGILSKRSVDNLSVGFHEDHGVGVPKSYVIEY

YVGKTVPTAPKNPSFVGNEDHVFNDSANWKPVTNLKAPAQLKAGEMNHFSFDKVETYAVRIRMVKADNKRGTSITEV

QIFAKQVAAAKQGQTRIQVDGKDLANFNPDLTDYYLESVDGKVPAVTASVSNNGLATVVPSVREGEPVRVLAKAENGD

ILGEYRLHFTKDKSLLSHKPVAAVKQARLLQVGQALELPTKVPVYFTGKDGYETKDLTVEWEEVPAENLTKAGQFTVR

GRVLGSNLVAEITVRVTDKLGETLSDNPNYDENSNQAFASATNDIDKNSHDRVDYLNDGDHSENRRWTNWSPTPSSNP

EVSAGVIFRENGKIVERTVTQGKVQFFADSGTDAPSKLVLERYVGPEFEVPTYYSNYQAYDADHPFNNPENWEAVPYR

ADKDIAAGDEINVTFKAIKAKAMRWRMERKADKSGVAMIEMTFLAPSELPQESTQSKILVDGKELADFAENRQDYQIT

YKGQRPKVSVEENNQVASTVVOSGEDSFPVLVRLVSESGKQVKEYRIHLTKEKPVSEKTVAAVQEDLPKIEFVEKDLAY

KTVEKKDSTLYLGETRVEQEGKVGKERIEFAINPDGSKEEKLREVVEVPTDRIVLVGTKPVAQEAKKPQVSEKADTKPID

SSEASQTNKAQLPSTGSAASQAAVAAGLTLLGLSAGLVVTKGKKEDZ (SEQ ID. NO. 3)
MKIMKXKYWTLAILFFCLFNNSVTAQEIPKNLDGNITHTQTSESFSESDEKQVDYSNKNQEEVDQNKFRIQIDKTELPVT

TDKHLEKNCCKLELEPQINNDIVNSESNNLLGEDNLDNKIKENVSHLDNRGGNIEHDKDNLESSIVRXYEWDIDKVTGG

GESYKLYSKSNSKVSIAILDSGVDLQNTGLLKNLSNMSKNYVPNKGYLGKEEGEEGIISDIQDRLGHGTAVVAQIVGDDN

INGVNPHVNINVYRIFGKSSASPDWIVKAWDAVDDGNDHNLSTGQYLMIDGEYEDGTNDFETFLKYKKAIDYANQKGV

IIVAALGNDSLNVSNQSDLLKLISSRIZKVRKPGLVVDVPSYFSSTISVGGIDRIGNLSDFSNKGDSDAIYAPAGSTLSLSEL

GLNNFINAEKYKEDWIFSATLGGYTYLYGNSFAAPKVSGAIAMIIDKYKLKDQPYNYMFVKKFWKKHYQZ (SEQ ID. NO. 4)
MKKTWKVFLTLVTALVAVVLVACGQGTASKDNKEAELKXVDFILDWTPNTNHTGLYVAKEKGYFKEAGVDVDLKLP

PEESSSDLVINGKAPFAVYFQDYMAKKLEKGAGITAVAAIVEHNTSGILSRKSDNVSSPKDLVGKKYGTWNDPTELAML

KTLVESQGGDFEKVEKVPNNDSNSITPIANGVFDTAWIYYGWDGILAKSQGVDANFMYLKDYVKEFDYYSPVIIANND

YLKDNKEEARKVIQAIKKGYQYAMEHPEEAADILIKNAPELKEKRDFVIESQKYLSKEYASDKEKWGQFDAARWNAFY

KWDKENGILKEDLTDKGFTNEFVKZ (SEQ ID. NO. 5)
MKRTWRNSFVTNLNTPFMIGNIEJPNRTVLAPMAOVTNSAFRTIAKELGAGLVVMEMVSDKGIQYNNEKTLHMLHIDE

GENPVSIQLFGSDEDSLARAAEFIQENTKTDIVDINMGCPVNKIVKNEAGAMWLKDPDKIYSIINIVQSVLDIPLTVKMR

TGWADPSLAVENALAEAAGVSALAMHGRTREQMYTGHADLETLYKVAQALTICIPFIANGDIRTVQEAKQRIEEVGA

DAVMIGRAAMGNPYLFNQINHYFETGEILPDLTFEDKMKIAYEHLKRLINLKGENVAVRERGLAPHYLRGTSGTSGAAKL

RGAISQASTLAEIETLLQLEKAZ (SEQ ID. NO. 6)
MIKNPKLLTKSFLRSFAILGGVGLVIHIAIYLTFPFYYIQLEGEKFNESARVFTEYLKTKTSDEIPSLLQSYSKSLTISAHLK

RDIVDKRLPLVHDLDIKDGKLSNYIVMLDMSVSTADGKQVTVQFVHGVDVYKEAKNILLLYLPYTFLVTIAPSFVFSYF

YTKRLLNPLFYISEVTSKMQDLDDNIRFDERJCDEVGEVGKQINGMYEELLKVIYELESRNEQIVKLQNQKVSFVRGAS

TABLE 2-continued

HELKTPLASLRMLENMQHNIGDYKDHPKYIAKSINKIDQMSHLLEEVLESSKFQEWTECRETTVKPVLVDILSRYQELAH

SIGVTIENQLTDATRVVMSLRALDKVLTNLISNAIKYSDKNGRVHSEQDGYLSIKNTCAPLSDQELEHLFDFYHSQIVTD

KDESSGLGLY1VNNILESYQMDYSFLPYEHGMEFKISLZ (SEQ ID. NO. 7)
MYLGDLMEKAECGQFSILLQESQTTVKAVMEETGFSKATLTKYVTLLNDKALDSGLELAIHSEDENLRLSIGAATK

GRDIRSLFLESAVKYQILVYLLYHQQFLAHQLAQELVISEATLGRHLAGLNQILSEFDLSIQNGRWRGPEHQIHYFYFCL

FKVWSSQEWEGHMQKPERKQEIANLEEICGASLSAGQKLDLVLWAHISQQRLRVNACQFQVIEEKMRCYPDNIFYLR

LLRKVPSFFAGQHIPLGVEDGEMMIFFSFLLSHRILPLHTMEYILGFGGQLADLLTQLIQEMKKEELLGDYTEDHVTYEL

SQLCAQVYLYKGYILQDRYKYQLENRHPYLLMEHDFKETAEEIFHALPAFQQGTDLDKKILWEWLQLIEYMAEGGQ

HMRIGLDLTSGFLVFSRMAAILKRYLEYNRFITTIEAYDPSRHYDLLVTNNPIHKKEQTPVYYLKNDLDMEDLVAIRQLLF

TZ (SEQ ID. NO. 8)
MEFSKKTRELSIKKMQERTLDLLHGGGITGAGVALQAAASGLETGLIEMQDFAEGTSSRSTKLVHGGLRYLKQFDVEV

VSDTVSERAVVQQIAPHIPKSDPMLLPVYDEDGATFSLFRLKVAMDLYDLLAGVSNTPAANKVLSKDQVLERQPNLKK

EGLVGGGVYLDFRNNDARLVIENIKRANQDGALANHKAEGFLFDESGKITGVVARDLLTDQVFEIKARLVINTTGPW

SDKVRNLSNKGTQPSQMRKGVHLVVDSSKIKVSQPVYFDTGLGDGRMVFVLPRENKTYEGTTDTDYTGDLEHPKVT

QEDVDYLLGIVNNRFPESNITIDDIESSWAGLRPLIAGNSASDYNGGNNGTISDESFDNLIATVESYLSKEKTREDVESAV

SKLESSTSEKHLDPSAVSRGSSLDRDDNGLLTLAGGKITDYRKMAEGAMERVVDIICAEFDRSFKLINSKTYPVSGGELN

PANVDSEIEAFAQLGVSRGLDSKEAHYLANLYGSNAPKVFALAHSLEQAPLSLADTLSHYAMRNELLTLSPVDFLLRR

TNHMLFMRDSLDSIVEPILDEMGRFYDWTEEEKATYRADVEAALANNDLAELKNZ (SEQ ID. NO. 9)
MMNELFGEFLGTLIILLGNGVVAGVVLPKTKSNSSGWIVITMGWGIAVAVAVFVSGKLSPAYLNPAVTIGVALKGGLP

WASVLPYILAQFAGAMLGQILVWLQFKPHYEAEENAGNILATFSTGPAIKDTVSNLISEILGTFVLVLTIPALGLYDFQA

GIGTFAVGTLIVGIGLSLGGTTGYALNPARDLGPRIMHSILPIPNKGDGDWSYAWIPVVGPVIGAALAVLVFSLFZ (SEQ ID. NO. 10)
MTKKKERISVIHREKILWLKWYFMRDKEQPKYSVLERKMFDAAKNQDMLAYQKYATIKQTSEADIRVQTSEADILEAVKE

VYVYNHMNVIGACQRILFISQSPAYDKLNKWPNIYSDLYFSVVPLPKMGVYHEMVGIZ (SEQ ID. NO. 11)
MKNSNEAEMKLLYTDIRTSLTEILTREAEELVAAGKRVFYIAPNSLSFEKERAVLEYLSQQASFSITVTRFAQMARYLVL

NDLPAKTTLDDIGLGLAFYKCLAELDPKDLRVYGAIKQDPQLIQQLIELYHEMTKSQMSFLDLENLTDEDKRADLLLIF

EKVTAYLNQGQLAQESQLSHLIEAIENDKVSSDFNQIALVIDGFTRFSAEEERVVDLLHGKGVEWIGAYASKKAYTSPFS

EGNLYQAVKFLHHLASKYQTPAQDCSQTHEKMDSFDKASRLLESSYDFSELALDVDEKDRENLQIWSCLTQKEELEL

VARSIRQKLHENSDLSYKHFRJLLGDVASYQLSLKTIFDQYQIPFYLGRSEAMAHHPLTQFVESILALKRYRPRQEDLINL

LRTDLYTDLSQSDIDAFEQYIRYLGINGLPAFQQTFTKSHHGKFNLERLNVLRLRILAPLETLFASRKQKAEKLLQKWSV

FLKEGAVTKQLQDLTITLEAVEQERQAEVWKAFCNVLEQFATVFAGSQVSLEDFLALLHSGMSLSQYRTIPATVDTVL

VQSYDLIAPLTADFVYAIGLTQDNLPKISQNTSLLTDEERQNLNQATEEGVQLLIASSENLKKNRYTMLSLVNSARKQLF

LSAPSLFNESESKESAYLQELIHFGFRRREKRMNHKGLSKEDMGSYHSLLSSLVAYHQQGEMSDTEQDLTFVKVLSRVI

GKKLDQQGLENPAIPTSPSSKTLAKDTLQALYPAKQEFYLSTSGLTEFYRNEYSYFLRYVLGLQEELRLHPDARSHGNFL

HRFEALQLPNEDSFDQRLEQAIQETSQERBFSAIYQESLEAQITKEVLLDVARTTGHILRHNPAIETIKEEANFGGKDQ

AFIQLDNGRSVFVRGKVDRIDRLKANGAIGVVDYKSSLTQFQFPHFFNGLNSQLPTYLAALKREGEQNFFGAMYLEMA

EPVQSLMAVKSLAGAVVEASKSMKYQGLFLEKESSYLGEFYNKNKANQLTDEEFQLLLDYNAYLYKKAAEKILAGRF

AINPYTENGRSIAPYVQQHQAITGFEANYHLGQARFLEKLDLADGKRLVGEKLKQAWLEKIREELNRZ

TABLE 2-continued (SEQ ID. NO. 12)
MKLIPFLSEEEIQKLQEAEANSSKEQKKTAEQIEAIYTSAQNILVSASAGSGKTFVMAERLDQLARGVEISQLFISTFTVK

AATELKERLEKJCISKKIQETDDVDLKQHLGRQLADLPNAAIGTMDSFTQKFLGKHGYLLDIAPNFRILQNQSEQULENE

VFHEVFEAHYQGKQKETFSHLLKNFAGRGKDERGLRQQVYKIYDFLQSTSNPQKWLSESFLKGFEKADFTSEKEKLTE

QIKQALWDLESFFRYHLDNDAKEIAKAAYLENVQLILDEEGSLNQESDSQAYQAVLARVVAISKEKNGRALTNASRKA

DLKPLADAYNEERKTQFAKLGQISDQIAILDYQERYHGDTWKLAKTFQSFMSDFVEAYRQRKRQENAPEFADISHYTIE

ILENFPQVRESYQERFHEVMVDEYQDTNHIQERMLELLSNGHNRFMVGDIKQSIYRFRQADPQCFNEKFQRYAQNPQEG

RLIILKENFRSSSEVLSATNDVFERLMDQEVGEINYDNKHQLVFANTKLTPNPDNKAAFLLYDKDDTGEEEESQRETKL

TGEMRLVIKEILKLHQEKGVAFKRIALLTSSRSRNOQILLALSEYGEPVKTDGEQNNYLQSLEVQVMLDTLRVIHNPLQD

YALVALMKSPMFGFDEDELARLSLQKAEDGVHENLYEKLVNAQKMASSQKGLIHTALAEKLKQFMDILASWRLYAKT

HSLYDLIWKIYNDRFYYDYVGALPNGPARQANLYALALRADQFEKSNFEKGLSRFIRMIDQVLEAQHDLASVAVAPPKD

AVELMTIHKSKGLEFPYVFILNMDQDINKQDSMSEVILSRQNGLGVKYIAKMETGAVEDHYPKTIKLSIPSLTYRQNEEE

LQLASYSEQMRLLYVAMTRAEKKLYLVGKGSREKLESKEYPAAKNGKLNSNTRLQARNFQDWLWAISKVFTKDKLNF

SYRFIGEDQLTREAIGELETKSPLQDSSQADNRQSDTIKEALEMLKEVEVYNTLHRAAIELPSVQTPSQUCKPYEPVMDM

EGVEIAGQGQSVGKKISFDLPDFSTKEKVTGAEIGSATHELMQRIDLSQQLTLASLTETLKQVQTSQAVRDKINLDKILAF

FDTVLGQEILANTDHLYREQPFSMLKRDQKSQEDFVVRGILDGYLLYENKIVLFDYKTDRYDEPSQLVDRYRGQLALY

EEALSRAYSIENIEKYLILLGKDEVQVVKVZ (SEQ ID. NO. 13)
MELARHAESLGVDALATIPPIYFRLPEYSVAKYWNDISSAAPNTDYVCYNIPQLAGVALTPSLYTEMLKNPRVIGVKNSS

MPVQDIQTFVSLGGEDMIVFNGPDEQFLGGRLMGARAGIGGTYGAMPELFLKLNQLIADKDLETARELQYAINAHGKL

TSAHGNMYGVIKEVLKINBGLNIGSVRSPLTPVTEEDRPVVEAAAALIRETKERFLZ (SEQ ID. NO. 14)
MYKTKCLREKLVLFLKIFFPIUYQFANYSASFVDTAMTGQYNTMDLAGVSMATSTWNPPFTPLTGIVSALVPIIGHHLG

RGKKEEVASDFYQFIYLALGLSVVLLGMVLPLAPIILNHIGLEAAVAAVAVRYLWFLSIGIIPLLLFSVIRSLLDSLGLTKL

SMYLMLLLLPLNSGFNYLLIYGAFGVPELGGAGAGLGTSLAYWVLLGISVLVLFKQEKLKALHLEKRIPLNMDKIKEGV

RLGLPIGGTVFAEVAIFSVVGLIMAKFSPLIIASHQSAMNFSSLMYAFPMSISSSAMAIVVSYEVGAKRFDDAKTYIGLGRW

TALIFAAFTLTFLYIFRGNVASLYGNDPKFIDLTVRFLTYSLFFQLADTFAAPLQGILRGYKDTVIPFYLGLLGYWGVAIP

VYAIZ (SEQ ID. NO. 15)
MSTLAKIEALLFVAGEDGIRVRQLAELLSLPPTGIQQSLGKLAQKYEKDPDSSLALIETSGAYRLVTKPQFAEILKEYSKA

PINQSLSRALETLIIAYKQPITRIEIDAIRGVNSSGALAKLQAFDLIKEDGKKEVLGRPNLYWITDYFLDYMGINHLEEL

PVIDELEIQAQESQLFGERIEEDENQZ (SEQ ID. NO. 16)
MDTMISRFFRHLPEALKSLKRNGWMTVAAVSSVMITLTLVAIFASVIFNTAKLATDIENNVRVVVYIRKDVEDNSQTIE

KEGQTVTNNDYHKVYDSLKNMSTVKSVTFSSKEEQYEKLTEIMGDNWKIFEGDANPLYDAYIVEANTPNDVKTIAEDA

KKIEGVSEVQDGGANTERLFKLASFIRVWGLGIAALLIFIAVFLISNTIRITIISRSREIQIMRLVGAKNSYIRGPFLLEGAFIG

LLGAIAPSVLVFIVYQIVYQSVNKSLVGQNLSMISPDLFSPLMIALLFVIGVFIGSLGSQGISMRRFLKIZ (SEQ ID. NO. 17)
MKKVRFIFLALLFFLASPEGAMASDGTWQGGQYLKEDGSQAANEWVFDTHYQSWFYIKADANYAENEWLKQGDDYF

YLKSGGYMAKSEWVEDKGAFYYLDQDGKMKRNAWVGTSYVGATGAKVIEDWVYDSQYOAWFYIKADGQHAEKEW

LQIKGKDYYFKSGGYLLTSQWINQAYVNASGAKVQQGWLFDKQYQSWFYIKBNGNYADKEWIFENGFHYYYLKSGGY

MAANEWEWDKESWFYLKFDGKMAEKEWVYDSHSQAWYYFKSGGYMTANEWIWDKESWFYLKSDGKIAEKEWVYD

TABLE 2-continued

SHSQAWYYFKSGGYMTANEWIWDKESWFYLKSDGKIAEKEWVYDSHSQAWYYFKSGGYMAKNETVDGYQLGSDGK
WLGGKTTNENAAYYQVVPVTANVYDSDGEKLSYISQGSVVWLDKDRKSDDKRLAITISGLSGYMKTEDLQALDASKD
FIPYYESDGHRFYHYVAQNASIPVASHLSDMEVGKKYYSADGLHFDGFKLENPFLFICDLTEATNYSAEELDKVFSLLNI
NNSLLENKGATFKEAEEHYHINALYLLAHSALESNWGRSKIAKDKNNFFGITAYDITPYLSAKTFDDVDKGILGATKWI
KENYIDRGRTFLGNKASGMNVEYASDPYWGEKIASVMMKINEKLGGKDZ (SEQ ID. NO. 18)
MKKVLQKYWAWAFVVIPLLLQAIPFYVPMFQGAFYSFTNWTGLTYNYKFVGLNNFKLLFMDPKFMNAIGFTAIIAIAM
VVEIALCIARVLNSKIKGQTFFRAWFFFPAVLSGLTVALIFKQVFNYGLPAIGNALHIEFFQTSLLGTKWGAIFAAVF
VLLWQOVAMPEIIFLAGLQSIPTEITEAARIDGATSKQVFWNIELPYLLPSVSMVFELALKGGLTAFDQVFAMTGGGPNN
ATTSLGLLVYNYAFKNNQFGYANAIAVILFFLIVVISHQLRVSKKFEIZ (SEQ ID. NO. 19)
MMKQDERKALIGKYILLILGSVLILVPLLATLFSSFKPTKDIVDNFFGFFTNFTWDNFSRLLADGIGGYYWNSVVITVLSL
LAVMIFIPMAAYSIARNMSKRKAFTIMYTLLILGIFVPFQVIMIPITVMMSKLGLANTPGLILLYLTYAIPQTLFLYVGYIKI
SIPESLDEAAEIDGANQFTTYFRIIFPMMKPMHATTMIINALWFWNDFMLPLLVLNRDSKMWTLPLFQYNYAGQYFND
YGPSFASYVVGIISITIVYLFFQRHIHSGMSNGAVKZ (SEQ ID. NO. 20)
MKSILQKMGEHPMLLLFLSYSTVISILAQNWMGLVASVGMFLFTIFFLHYQSILSHKFFRLILQFVLFGSVLSAAFASLEH
PQIVKKPNYAPLSPNMQVWHQNRAEVTFFNPNYYGIICCFCIMIAPYLFTTTKLNWLKVFCVIAGPVNLFGLNFTQNRT
AFPAIIAGAIIYLFTTTKNWKAFWLSIGVFAIGLSFLFSSDLGVRMGTLDSSMEERISIWDAGMALFKQNPFWGEGPLTYM
NSYPRIHAPYHEHAHSLYIDTILSYGIVGTILLVLSSVAPVRLMMDMSQESGKRPIIGLYLSFLTVVAVHGIFDLALFWIQS
GFIFLLVMCSIPLEHRMLVSDMTDZ (SEQ ID. NO. 21)
MSKMDVQKIIAPMMKFVNMRGIIALIKDGMLAILPLTVVGSLFLIMGQLPFEGLNKSIASVFGANWTEPPMQVYSGTFAI
MGLISCFSIAYSYAKNSGVEALPAGVLSVSAFFILLRSSYIPKQGEAIGDAISKVWFGGQGHGAHIGLVVGSIYTFFIKRKIV
IKMPEQVPQAIAKQFEAMIPAVIFLSSMIVYILAKSLTNGGTFIEMIYSAIQVPLQGLTGSLYGAIGIAFFISFLWWFGVH
GQSVVNGVTALLLSNLDANKAMLASANLSLENGAHIVTQQFLDSFLILSGSGITFGLVVAMLFAAKSKQYQALGKVA
AFPAIFNVNEPVVFGFPEVMNPVMFVPFILVPVLAAVIVYGAIATGFMQPFSGVTLPWSTPAILSGFLVGGWQGVETQLVI
LAMSTLVYFPFFKVQDRLAYQNEIKQSZ (SEQ ID. NO. 22)
MKKKDLVDQLVSEIETGKVRTLGIYGHGASGKSTFAQELYQALDSTTVNLLETDPYITSGRHLVVPKDAPNQKVTASLP
VAHELESLQRDILACRRVWMSZ (SEQ ID. NO. 23)
MKKRYLVLTALLALSLAACSQEKTKNEDGETKTEQTAKADGTVGSKSQGAAQKKAEVVNKGDYYSIQGKYDEIIVAN
KHYPLSKDYNPGENPTAKAELVKLIKAMQEAGPPISDHYSGFRSYETQTKLYQDYVNQDGKAAADRYSARPGYSEHQT
GLAFDVIGTDGDLVTEEKAAQWLLDHAADYGFVVRYLKGKEKETGYMAEEWHLRYVGKEAIKEIAASGLSLEEYYGF
EGGDYVDZ (SEQ ID. NO. 24)
MREPDFLNHFLKKGYFKKHAKAVLALSGGLDSMFLFKVLSTYQKELEEELILAHVNHKQRIESDWEEKELRKLAAEAE
LPIYISNFSGEFSEARARNFRYDFFQEVMKKTGATALVTAHHADDQVETIFMRLIRGTRLRYLSGIKEKQVVGEIEIIRPFL
HFQKKDFPSIFHFEDTSNQENHYFRNRIRNSYLPELEKENPRFRDAILGIGNEILDYDLAIAELSNNINVEDLQQLPSYSES
TQRVLLQTYLNRFPDLNLTKAQFAEVQQILKSKSQYRHPIKNGYELEKEYQQFQICKISPQADEKBDELVLHYQNQVAY
QGYLFSFGLPLEGELIQQIPVSRETSIHIRHRKTGDVLIKNGHRKKLRRLFIDLKIPMEKRNSALIIEQFGEIVSILGIATNNL
SKKTKNDIMNTVLYIEKIDRZ

TABLE 2-continued (SEQ ID. NO. 25)
MRKPLIILLLPSFLTISKVVSTEKEVVYTSKEIYYLSQSDFGIYFRBKLSSPMVYGEVPVYANEDLVVESGKLTPKTSFQIT EWRLNKQGIPVPKLSNHQFIAADKRFLYDQSEVTPTIICKVWLESDFKLYNSPYDLKEVKSSLSAYSQVSIDKTMFVEGRE

FLHIDQAGWVAKESTSEEDNRMSKVQEMLSEKYQKDSFSIYVKQLTTGKSAGINQDEKMYAASVLKLSYLYYTQEKIN

EGLYQLDTTVKYVSAVNDFPGSYKPEGSGSLPKKEDNKEYSLKDUTKVSKESDNVAHNLLGYYISNQSDATFKSKMSA

IMGDDWDPKEKLISSKMAGKFMEAIYNQNGFVLESLTKTDFDSQRIAKGVSVKVAHKIGDADEFKHDTGVVYADSPFIL

SIFTKNSDYDTISKIAKDVYEVLKZ (SEQ ID. NO. 26)
MKKQNNGLIKNPFLWLLFIFFLVTGFQYFYSGNNSGGSQQINYTELVQEITDGNVKELTYQPNGSVIEWSGVYKNPKSTK

EETGIQFFTPSVTKVEKFTSTILPADITVSELQKLATDHKAEVTVKHBSSSGIWINLLVSWPFGILFFFLFSNIMGNMGGG

NGRNPMSFGRSKAXANKBDIKVRFSDVAGAEEEKQELVEVVEFLKDPKRFKLGARIPAGVLLEGPPGTGKLLLAKA

VAGEAGVPFFSDSGSDLVEMFVGVGASRVRSLFEDAKKAAPAIIFIDEIDAVGRQRGVGLGGGNFRTRQTLNQLLIEMDG

FEGNEGIIVIAATNSDVLDPALLRPGRFDRKVLVGRPDVKGEAILKVHAKNKPLAEDVDLKLVAQQTPGFGFVGADLEN

VLNEAALVAARRNSIIDASDIDEAEDRVIAGPSKKKDKTVSQKERELVAYHEAGHIVGLVLSNARVVHKVTIVPRGRA

GGYMIALPKEDQMLEDMKEQLAGLMGGRVAEEIIFNVQITGASNDFEQATQMARAMVTEYGMSEKLGPVQYEG

NHAMLGAQSPQSEQTAYEIDEEVRSLLNEARNKAAEHQSNRETHKLLEALLKYETLDSTQIKALYETGKMPEAVE

EESHALSYDEVKSKMNDEKZ (SEQ ID. NO. 27)
MKRSSLLVRMVISIFLVFLILLALVGTFYYQSSSSAIEATIEGNSQSQTSHFIQSYIKKLETTSTGLTQQTDVLAYAENP

SQDKVEGIRDLFLTILKSDKDLKTVVLVTKSGQVISTDDSVQMKTSSDMMAEDWYQKAIHQGAMPVLTPARKSDSQW

VISVTQELVDAKGANLGVLRLDSYETLEAYLNQLQLGQQGFAFIINENHEFVYHPQHTVYSSSSKMEAMKPYDTGQG

YTPGHKSYVSQEKIAGTDWTVLGVSSLEKLDQVRSQLLWTLLGASVTSLLVCLCLVWFSLKRWIAPLKDLRETMLEIAS

GAQNLRAKEVGAYELREVTRQFNAMLDQIDQLMVAIRSQEETTRQYQLQALSSQINPHFLYNTLDTIIWMAEFHDSQR

VVQVTKSLATYFRLALNQGKDLICLSDEINHVRQYLFIQKQRYGDKLEYEINENVAFDNLVLPKLVLQPLVENALYHGI

KEKEGQGHIKLSVQKQDSGLVIREDDGVGFQDAGDSSQSQLKRGGVGLQNVDQRLKLHPGANYHMKIDSRPQKGTKV

EIYINRIETSZ (SEQ ID. NO. 28)
MKRSSLLVRMVISIFLVFLILLALVGTIYYQSSSSAIEATIEGNSQTTISQTSHFIQSYIKKLETTSTGLTQQTDVLAYAENP

SQDKVEGIRDLFLTILKSDKDLKTVVLVTKSGQVISTDDSVQMKTSSDMMAEDWYQKAIHQGAMPVLTPARKSDSQW

VISVTQELVDAKGANLGVLRLDISYETLEAYLNQLQLGQQGFAFIINENHEFVYHPQHTVYSSSSKMEAMKPYIDTGQG

YTPGHKSYVSQEKIAGTDWTVLGVSSLEKLDQVRSQLLWTLLGASVTSLLVCLCLVWFSLKRWIAPLKDLRETMLEIAS

GAQNLRKEVGAYELREVTRQFNAMLDQIDQLMVA1RSQEET1RQYQLQALSSQINPHFLYNTLDTUWMAEFHDSQR

VVQVTKSLATYFRLALNQGKDLICLSDE
NHVRQYLPIQKQRYGDKLEYEINENVAFDNLVLPKLVLQPLVENALYHGI

KEKEGQGHIKLSVQKQDSGLVIRIEDDGVGFQDAGDSSQSQLKRGGVGLQNVDQRLKLHFGANYHMKIDSRPQKGTKV

EIYINRIETSZ (SEQ ID. NO. 29)
MFFKLLREALKVKQVRSKILETIFWLVFRIGTSITVPGVNANSLNALSGLSFLNMLSLVSGNALKNFSIFALGVSPYITASI

VVQLLQMDILPKFVEWGKQGEVGRRKLNQATRYIALVLAFVQSIGITAGFNTLAGAQLIKTALTPQVFLTIGIILTAGSMI

VTWLGEQETDKGYGNGVSMHFAGWSSIPEMIQGIYVDYFVNVPSSRITSSIIFVHLIITVLLIIYFTTYVQQAEYKIPIQYTK

VAQGAPSSSYLPLKVNPAGVIPVIFASSITAAPAAILQFLSATGHDWAWRVAQEMLATTSPTGIAMYALLIILFTFFYTF

VQINPEKAAERYKRVVPISMEFVLVKVQKNICLNFFVVLQLLVPSSLVZ

TABLE 2-continued (SEQ ID. NO. 30)
MDIRQVTETIAMIEEQNFDIRTITMGISLLDCIDPDENRAAEKIYQKITTKAANLVAVGDEIAAELGIPIVNKRVSVTPISLIG

AATDATDYVVLAKALDKAAKE1GVDFIGGFSALVQKGYQICGDEILINSIPRALAETDKVCSSVNIGSTKSGINMTAVAD

MGRIIKETANLSDMGVAKLVVFANAVEDNPFMAGAFHGVGEADVIINVGVSGPGVVKRALEKVRGQSPDVVAETVKK

TAFKITRIGQLVGQMASERLGVEFGIVDLSLAPTPAVGDSVARVLEEMGLETVGTHGTTAALALLNDQVKKGGVMAC

NQVGGLSGAFIPVSEDEGMEAAVQNGSLNLEKLEAMTAICSVGLDMIAIPEDTPAETIAAMIADEAAIGVINMKTTAVRII

PKGKEGDMIEIGGLLGTAPVMKVNGASSVDFISRGGQIPAPIHSFKNZ (SEQ ID. NO. 31)
MTQIIDGKALAAKLQGQLAEKTAKLKEETGLVPGLVVILVGDNPASQVYVRNKERSALAAGFRSEVVRVPETITQEELL

DLIAKYNQDPAWHGILVQLPLPKHIDEEAVLLAIDPEKDVDGFHPLNMGRLWSGHPVMIPSTPAGIMEMFHEYGIDLEG

KNAVVIGRSNIVGKPMAQLLLAKNATVTLTHSRTHNLSKVAAXADILVVAIGRAKFVTADFVKPGAVVIDVGMNRDEN

GKLCGDVDYEAVAPLASHITPVPGGVGPMTITMLMEQTYQAALRTLDRKZ (SEQ ID. NO. 32)
MSKFNRIHLVVLDSVGIGAAPDANNFVNAGVPDGASDTLGHISKTVGLNVPNMAKIGLGNIPRETPLKTVAAESNPTGY

ATKLEEVSLGKDTTGHWEIMGLNITEPFDTFWNGFPEE1LTKIEEFSGRKVIREANKPYSGTAVIYDFGPRQMSTGELH

YTSADPVLQIAAHEDIIPLDELYRICEYARSITLERPALLGRIIARPYVGEPGNFTRTANRRDLAVSPFFPTVLDKLNEAGI

DTYAVGKINDIFNGAGINHDMGHNKSNSHGIDTLLKTMGLAEFEKGFSFTNLVDFDALYGHRRNAHGYRDCLHEPDE

RLPEHAAMRENDLLLITADHGNDPTYAGTDHTREYIPLLAYSPAFKGNGLIPVGHFADISATVADNFGVETAMIGESFL

DKLVZ (SEQ ID. NO. 33)
MFISISAGLVTFLLTLVEPAFIQFYRKAQITGQQMNEDVKQHQAKAGTPTMGGLVPLITSVLVAFFFALFSSQFSNNVGM

ILFILVLYGLVGFLDDDFLKVFRKINEGLNPKQKLALQLLGGVIFYLFYERGGDILSVPGYPVHLGFFYIPFALFWLVGFSN

AVNLTDGVDGLASISVVISLSAYGVIAYVQGQMDLLLVILAMIGGLLGFFIPNHKPAKVFMGDVGSLALGGMLAAISMA

LHQEWTLLUGIVYVFEFTSVMMQVSYFKLTGGKPIFRMTPVHHHFELGGLSGKGNPWSEWKVDFFFWGVGLLASLLT

LAILYLMZ (SEQ ID. NO. 34)
LFKKNKDELNIALPAMGENFLQMLMGMVDSYLVAHLGLIAISGVSVAGNIMYQAIRALGAAISSVLSKSIGQKDQSKLA

YNVTEALKITLLLSILLGFLSIFAGKSMIGLLGTERDVAESGGLYLSLVGGSIVLLGLMTSLGALIRATHNPRLPLYVSFL

SNALNILFSSLAIFVLDMGIAGVAWGTIVSRLVGLVILWSQLKLPYGKPTFGLDKELLTLALPAAGERLMMRAGDVVHA

LVVSFGTEAVAGNAIGEVLTQFNYMPAFGVATATVMLLARAVGEDDWKRVASLSKQTLFLSLFMLPLSFSIYVLGVP

LTHLYTDSLAVEASVLVTLFSLLGTPMTTGTVIYTAVWQGLGNARLPFYATSIGMWCIRIGTGYLMGIVLGWGLPGIW

AGSLLDNGFRWLFLRYRYQRYMSLKGZ (SEQ ID. NO. 35)
MQTQEKRSQAAVLGLQHLAMYSGSILVPIMIATALGYSAEQLTYLISTDIFMCGVATFLQLQLNKYFGIGLPVVLGVA

FQSVAPLIMIGQSHGSGAMFGALIASGIYVVLVSGIFSKVANLFPSIVTGSVITTIGLTLIPVAIGNMGNNVPEPTGQSLLA

AITVLIILINIFTKGFIKSISILIGLVVGTAIAATMGLVDFSPVAVAPLVHPTPLYFG,PTFEISSIVMMCIIATVSMVEST

GVYLALSDITKDPIDSTRLRNGYREGLAVLLGGIFNTFPYTGFSQNVGLVKLSGIKKRLPIYYAAGFLVLLGLLPKFGA

LAQIIPSSVLGGAMLVMFGFVSIQGMQILARVDFANNEHNFLIAAVSIAGVGLNNSNLFVSMPTAFQMFFSNGIVVASL

LAIVLNAVLNHKKKZ (SEQ ID. NO. 36)
MKDRKEYLQDKGKVTVNDLAQALGKDSSKDFRELIKTLLMERKHQIRFEEDGSLTLEIKKKHEITLKGIFHAHKNGFG

FVSLEGEEDDLFVGKNDVNYAIDGDTVEVVHCKVADRNKGTAAEAKIIDILEHSLTTVVGQIVLDQEKPKYAGYISKN

QK1SQPIYVKKPALKLEGTEVLKVPEDKYPSKKHDFFVASVLDVVGHSTDVGIDVLEVLESMDIVSEFPEAVVKEAESVP

TABLE 2-continued

```
DAPSQKDMEGRLDLRDEDGADAKDLDOAVHIKALKNGNLEPGVHADVSYYEGSALDKEALNRTSVYVTD
RVVPMLPERSNGICSLNPQVDRLTQSAIMEIDKHGRVVNTQTVIKTSFRMTYSDVNDILAGDEEKEYHKIVSSIE
LMAKLHETLENMRVKRGALNFDTNEAKILVDKQGKPVDIVLRQRGIAERMIESFMLMANETVAEHFSKLDLPRYIHE
BPKAEKVQKFIDYASSFGLRIYGTASELSQEALQDIMRAVEGBPYADVLSMMLRSMQQARYSEHNHGHYGLAADYYT
HFTSPIRRYPDLLVHRMIRDYGRSKEIAEHFEQVIPEIATQSSNRERRAIEAEREVEAMKKAEYMEEYVGEEYDAVVSSIV
KFGLFVELPNTVEGLINTNLPEFYHFNERDLTLRGEKSGITFRVGQQIRIRVERADKMTGEIDFSFVPSEDFDVIEKGLKQS
SRSGRGRDSNRRSDKKEDKRKSGRSNDKRKHSQKDKKKKGKKPFYKEVAKKGAKHGKGRGKGRRTKZ
```

(SEQ ID. NO. 37)
```
MGTTGFTIIDLIILIVYLLAVLVAGIYFSKKEMKGKEFFKGDGSVPWYVTSVSIFATMLSPISFLGLAGSSYAGSWLWFA
QLGMVVAIPLTHIILPIFARDIDTAYDYLDKRFNSKALRISALLFIIYQLGRMSUMYLPSAGLSVLTGIDINILIILMGVV
AIVYSYTGGLKSVLWTDFIQGVILJSGVVLALFVLIANIKGGFGAVAETLANGKFLAANEKLFDPNLLSNSIFLIVMGSGP
TILSSYASSQDLVQRFTTTQNIKKLNKMLFTNGVLSLATAVFYLIGTGLYVFYQVQNADSAASNIPQDQIFMYFIAYQL
PVGITGLILAAIYAASQSTISTGLNSVATSWTLDIQDVISKNMSDNRRTKIAQFVSLAVGLPSIGVSIVMAHSDIKSAYEWF
NSFMGLVLGLLGGVRLGVSKKANKQGAYAALPIVMVFICYFLPPTAVSYWAYSLISISVSVVSGYIVSVLTGNKVS
APKYTTIEDITEIKADSSWEVRMZ
```

(SEQ ID. NO. 38)
```
MKFSKKYAGSAVIVSLSLCAYALNQHRSQENKDNNRVSYVDGSQSSQKSENLTPDQVSQKEGIQAEQAEQIVIKITDQGYV
TSHGDHYHYYNGKVPYDALFSEELLMKDPNYQLKDADIVNEVKGGYUKVDGKYYVYLKDAAHADNVRTKDEINRQK
QEHVKDNEKVNSNVAVARSQGRYTNDGYVPNPADIIEDTGNAYIVPHGGHYHYIPKSDLSASELAAAKAHLGKNM
QPSQLSYSSTASDNNTQSVAKGSTSKPANKSENLQSLLKELYDSPSAQRYSESDGLVIDPAKIISRTPNGVAIPHGDHYHP
IPYSKLSALEEKTARVPISGTGSTVSTNAKPNEVVSSLGSLSNPSSLTTSKELSSASDGYIFNPKDIVEETATAYWRHGD
HFHYIPKSNQIGQPTLPNNSLATPSPSLPINPGTSHEKHEEDGYGFDANRIIAEDESGFVMSHGDHNHYFFKKDLTEEQIK
VRKNIZ
```

(SEQ ID. NO. 39)
```
MKKRAIVAVIVLLLIGLDQLVKSYIVQQIPLGEVRSWIPNFVSLTYLQNRGAAPSILQDQQLLFAVITLVVVIGAIWYLHK
HMEDSFWMVLGLTLUAGGLGNFIDRVSQGPVVDMFHLDFINFAIFNVADSYLTVGVIILLIAMLKEEINGNZ
```

(SEQ ID. NO. 40)
```
MNTNLASFIVGLHDENDRFYFVQKDGQTYALAKEEGQHTVGDTVKGFAYTDMKQKLRLTTLEVTATQDQFGWGRVT
EVRKDLGVFVDTGLPDKEIVVSLDILPELKELWPKXGDQLYIRLEVDKKDRIWGLLAYQEDFQRLARPAYNNMQNQN
WPAIVYRKLSGTFVYLPENNNMLGFIHPSERYAEPRLGQVLDARVIGFREVDRTLNLSLKPRSFEMLENDAQMILTYLS
SNGGFMTLNDKSSPDDIKATFGISKGQFKKALGGLMKAGKIKQDQFGTELIZ
```

(SEQ ID. NO. 41)
```
MKDVSLFLLKKVFKSRLNWIVLALFVSVLGVTFYLNSQTANSHSLESRLESR1AANERAINENEEKLSQMSDTSSEEYQF
AXNNLDVQKNLLTRKTEILTLLKEGRWKEAYYLQWQDEBKNYEFVSNDPTASPGLKMGVDRERKIYQALYPLNIKAH
TLEFPTHGIDQIVWILEVIIPSLFVVAIIFMLTQLFAERYQNHLDTAHLYPVSKVTFAISSLGVGVGYVTVLFIGICGFSPLV
GSLISGFGQLDYPYNYSLVNQEVTIGKIQDVLFPGLLLAFLAFIVIVEVVYLIAYPFKQKMPVLFLSLIGIVGLLFGIQTIQP
LQRIAHLIPFTYLRSVEILSGRLPKQIDNVDLNWSMGMVLLPCLIIFLLLGILFISRWGSSQKICEFFNRFZ
```

(SEQ ID. NO. 42)
```
MMKFILDIVSTPAILVALIAILGLVLQKKKLPDIIKGGIKTFVGFLVVSGGAGIVQNSLNPFGTMPEHAPHLSOVVPNNEAI
VAVAUITYGSATAMIMFAGMVFNILIARFTRFKYIFLTGHHTLYMACMIAVILSVAGFTSLPLILLGGLALGUMSISPAF
VQKYMVQLTGNDKVALGHFSSLGYWLSGFTGSLIGDKSKSTEDIICPPKSLAPLRDSTVSITLSMAVIYUVAIFAGSEYIEK
EISSGTSGLVYALQLAGQFAAGVFVLAGVRLILGEIVPAPKGISERLVPNSKPALDCPIVYTYAPNAVLIGFTSSFVGGLVS
```

TABLE 2-continued

MVIMIASGTVVILPGVVPHFFCGATAGVTGNASGGVRGATIGAPLQGILISFLPVFLMPVLGGLGFQGSTFSDADFGLSGII

LGMLNQFGSQAGIVIGLVLILAVMFGVSPIKKPSATEEZ (SEQ ID. NO. 43)
MIKTFLSALSVILFSIPIITYSF-
PPSSNLNZWLSTQPILAQIYAFPLATATMAAILSFLFFFLSFYKKNKQIRFYSGILLLLSLIL

LLFGTDKTLSSASNKTKTLKLVTWNVANQIEAQHIERIFSKFDADMAIFPELATNIRGEQENQRIKLLFHQVGLSMANYD

IFTSPPTNSGIAPVTVIVKXSYGFYTEAKTFHTTRFGTIVLHSRKQNIPDIIALHTAPPLPGLMEIWKQDLNIIHNQLASKYP

KAIIAGDFNATMRHGALAKISSHRDALNALPPFERGTWNSQSPKLFNATIDHILLPKNHYYVKDLDIVSFQNSDHRCIFT

EITFZ (SEQ ID. NO. 44)
MNPIQRSWAYVSRKRLRSFLILLVLLAGISACLTLMKSNKTVESNLYKSLNTSPSIKKIENGQTFKLSDLASVSKIKGL

ENVSPELEVAKLKDKEAVTGEQSVERDDLSAADNNLVSLTALEDSSKDVTFTSSAFNLKEGRLHLQKGDSKKILHEEL

AKKNGSLHDKIGLDAGQSESGKGQTVEFEIIGWSGKKQEKFTGLSSDFSENQVFTDYESSQTLLGNSEAQVSAARFYVE

NPKEMDGLMKQVENIALENQGYQVEKENKAFEQIKDSVATFQTPLTIFLYGMLIAGAGALILVLSLWLRERVYEVGIL

LALGKGKSS1FLQFCLEVVLVSLGALLPAFVAGNAITTYLLQTLLASGDQASLQDTLAKASSLTSILSFAESYVFLVLLS

CLSVALCFLFLFRKSPKEILSSISZ (SEQ ID. NO. 45)
MLHNAFAYVTRKFFKSIVTFLIILLMASLSLVGLSIKGATAKASQETFKNITNSFSMQINRRVNQGTPRGAGNEKGEDIKKI

TENKAIESYVKRINAIGDLTGYDLIETPETKKNLTADRAKRFGSSLMITGVNDSSKEDKFVSGSYKLVEGEHLTNDDKDK

ILLHKDLAAKHGWKVGDKVKLDSNIYDADNEKGAKETVEVTIKGLFDGHNKSAVTYSQELYENTAITDIHTAAKLYGY

TEDTAIYGDATFFVTADKNLDDVMKELNGISGINWKSYTLVKSSSNYPALEQSISGMYXMANLLFWGSLSPSVLLLALL

LSLWINARRKEVGILLSIGLKQASILGQFITESILIAIPALVSAYFLANYTARAIGNTVLANVTSGVAKQASKAAQASNLGG

GAEVDGFSKTLSSLD1SIQTSDFIIIFVLALVLVVLVMALASSNLLRKQPKELLLDGEZ (SEQ ID. NO. 46)
MSQDKQMKAVSPLLQRVINISSIVGGVGSLIFCIWAYQAGILQSKETLSAFIQQAGIWGPPLFIFLQILQTVVPIIPGALTSV

AGVFIYGHIIGTIYNYIGIVIGCAIIFYLVRLYGAAFVQSVVSKRTYDKYIDWLDKGNRFDRFFIFMMIWPISPADFLCMLA

ALTKMSFKRYMTIIILTKPFTLVVYTYGLTYIIDFEWQMLZ (SEQ ID. NO. 47)
MRNMWVIKETYLRHVESWSFFFMVISPFLFLGISVGIGHLQGSSMAKNNKVAVVTTVPSVAEGLKNVNGVNFDYKDE

ASAKEAIKEEKLKGYLTIDQEDSVLKAVYHGETSLENGIKFEVTGTLNELQNQLNRSTASLSQEQEKRLAQTIQFTEKIDE

AKENXKFIQTIAAGALGFFLYMILITYAGVTAQEVASEKGTKIMEVVFSSIRASHYFYARMMALFLVILTHIGIYVVGGL

AAVLLFKDLPFLAQSGILDHLGDAISLNTLLFILISLFMYVVLAAFLGSMVSRPEDSGKALSPLMILIMGGFFGVTALGAA

GDNLLLKIGSYIPFISTFFMPFRTINDYAGGAEAWISLALTVWAVVATGFIGRMYASLVLQTDDLGIWKTFKRALSYKZ (SEQ ID. NO. 48)
MTETIKLMIKAHTSVRRFKEQEIPQVDLNEILTAAQMASSWKNFQSYSVIVVRSQEKKDALYELVPQEAIRQSAVFLLFV

GDLNRAEKGARLHTDTFQPQGVEGLLISSVDAALAGQNALLAAESLGYGGVHGLVRYKSEEVAELFNLPDYYTYSVFG

MALGVPNQHHDMKPRLPLENVVFEEEYQEQSTEAIQAYDRVQADYAGARATTSWSQRLAEQFGQAEPSSTRKNLEQK

KLLZMLKLIAIVGTNSKRSTNRQLLQYMQKHFTDKAEIELVEIKAIPVFNKPADKQVPAEILEIAAKIEEADGVHGTPEYD

HSIPAVLMSALAWLSYGIYPLLNKPIMITGASYGTLGSSRAQLQLRQILNAPEIKANVLPDEFLLSHSLQAFNPSGDLVDL

DVIKKLDAIFDDPRIFVKITEKLRNAQELLRKDAEDFDWENLZ (SEQ ID. NO. 49)
MNTYQLNNGVEIPVLGFGTFICAKDGEEAYRAVLEALKAGYRHIDTAAIYQNEESVGQAIKDSGVPREEMFVTTKLWNS

QQTYSQTRQALEKSIEKLGLDYLDLYLIHWPNPKPLRENDAWFTRNAEVWRAMEDLYQEGKIRAIGVSNFLPHHLDAL

TABLE 2-continued

LETATIVPAVNQVRLAPGVYQDQVVAYCREKGILLEAWGPPGQGELFDSKQVQEIAANHGKSVAQLALAWSLAEGFLP

LPKSVTTSRIQANLDCFGIELSHEERETLKTIAVQSGAPRVDDVDFZ (SEQ ID. NO. 50)
MRCKMLDPIAIQLGPLAIRWYALCIVTGLILAVYLTMKEAPRKKIIPDDLDPILVAFPLAILGARLYYVIFRFDYYSQNLG

EIFAIWNGGLAIYGGLITGALVLYIFADRKLINTWDFLDIAAPSVMIAQSLGRWGNFFNQEAYGATVDNLDYLPGRRDQ

MYIEGSYRQPTFLYESLWNLLGFALILIFRRKWKSLRRGHITAFYLIWYGFGRMVIEGMRTDSLMFFGFRVSQWLSVVLI

GLGIMIVIYQNRKKAPYYITEEENZ (SEQ ID. NO. 51)
MGKLSSILLGTVSGAALALFLTSDKGKQVCSQAQDPLDDLREDPEYAKEQVCEKLTEVKEQATDFVLKTKEQVESGEIT

VDSILAQTKSYAFQATEASKNQLNNLKEQWQEKAEALDDSEEIVIDITEEZ (SEQ ID. NO. 52)
MKTKLIFWGSMLFLLSLSILLTIYLAWIFYPMEIQWLNLTNRVYLKPETIQYNFHILMNYLTNPFSQVLQMPDFRSSAAG

LNHFAVVKNLFHLVQLVALVTLPSFYVFVNRIVKKDFLSLYRKSLLALVVLPVMIGLGGVLIGFDQFFTLFHQILFVGD

DTWLFDPAKDPVIMILPETFFLHAFLLFFALYENFFGYLYLKSRRKZ (SEQ ID. NO. 53)
MTYHFTEEYDHVIGAGHAGVEASLAASRMGCKVLLATINIEMLAFMPCNPSIGGSAKGIVVREVDALGGEMAKTIDKT

YIQMKMLNTGKGPAVRALRAQADKELYSKEMRKTVENQENLTLRQTMIDEILVEDGKVVGVRTATHQEYAAKAVNT

TGTALRGEIIIGDLKYSSGPNHSLASINLADNLKELGLEIGRFKTGTPPRVKASSINYDVTEIQPGDEVPNHFSYTSRDEDY

VKDQVPCWLTYTNGTSHEUQNNLHRAPMFTGVVKGVGPRYCPSIEDKIVRFADKERHQLFLEPEGRNTEEVYVQGLST

SLPEDVQRDLVHSIKGLENAEMMRTGYAIEYDMVLPHQLRATLETKKISGLFTAGQTNGTSGYEEAAGQGUAGINAAL

KIQGKPELILKRSDGYIGVMIDDLVTKGTIEPYRLLTSRAEYRLILRHDNADMRLTEMGREIGLVDDERWARFEIKICNQF

DNEMKRLDSIKLKPVKETNAKVEEMGFKPLTDAVTAKEFLRRPEVSYQDVVAFIGPAAEDLDDKIIELIETEIKYEGYISK

AMDQVAKMKRMEEKRIPANIDWDDIDSIATEARQKFKUNPETIGQASRISGVNPADISILMVYLEGKNRSISKTLQKSKZ (SEQ ID. NO. 54)
MTKQVLLVDDEEHILKLLDYHLSKEGFSTQLVTNGRKALALAETEPFDFILLDIMLPQLDGMEVCKRLRAKGVKTPIM

MVSAKSDEFDKVLALELGADDYLTKPFSPRELLARVKAVLRRTKGEQEGDDSDNIADDSWLFGTLKVYPERHEVYKA

NKLLSLTPKEFESDKNPFFEVFKVSKVTAQZ (SEQ ID. NO. 55)
MTTFKDGFLWGGAVAAHQLEGGWQEGGKGISVADVMTAGRHGVAREITLGVLEGKYYPNHEAIDFYHRYKEDIALF

AEMGFKCPRTSIAWTRFPKGDELEPNEEGLQFYDNLPDECLKNGIEPVITLSHFEMPYHLVTEYGGWKNRKLIDFPARE

AEVVFKRYKDKVKYWMTFEINNQANYQEDFAPFTNSGIVYEEGDNREAIMYQAAHYELVASARAVKIGHEINPDFQI

YYMSFAIDSHRENNPYDYLETEDLVKNNYVKASEWEWQIDPEGLRYALNWFTDHYHLPLFNENGFGMDQVAADG

MVHDDYREYLGAHIREMKKAVVEDGVDLMGYTPWGCIDLVSAGTGEMRKRYGFIYVDKDDNGKGSYNRSPKKFG

WYKEVISSNGESVEZ (SEQ ID. NO. 56)
MDQQNGLFGFLENHVMGPMGKLAQPKVVLTAAGMAAVPFWGSMFLVFSILPQAPSPPWADIFSASFDKFTSLY

MVANYATMGSLSLYFVLSLAYELTKIYAEEEELNMNPLNGALLALMAFVMTVPQUFDGGMMKTSLKEGAVIADG

WAMGNVVARFGTTGIFTAHMAIVTVLIYRMCVKHNWVIKMPEAVPEGVSRGPTALVPGFVVAFVVIFINGLLVAMGT

DIKVLMPFGFVSNLTNSWIGLMUYLLTQLLWWGIHGANIVFAFVSPIALANMAENAAGGHFAVAGEFSNMFLVIAGGS

GATLGLCLYIAFASKSEQLKIGRSVVPALFNINEPLILGLPIIYNPALAIPFILAPMVTATIYYVANSLNFIKPIIAQVPWP

TPVGIGAFLGTADLRAVLVALVCAFAAPLVYLPFTRVYDQKLVKEEQGIZ

TABLE 2-continued (SEQ ID. NO. 57)
MKKFYVSPIFPILVGLIAFGVLSTFIIFVNNNLLTVLILPLFVGGYVFLFKKLRVHYTRSDVEQIQYVNHQAEESLTALLEQ

MPVGVMKLNLSSGEVEWFNPYAELILTKEGDFDLEAVQTIIKASVGNPSTYAKLGEKRYAVHMDASSGVLYFVDVSR

EQAITDELVTSRPVIGVSVDNYDDLEDETSESDISQENSFVANFISEFSEKHMMFSRRVSMDRFYLFTDYTVLEGLMNDK

FSVIDAFREESKQRQLPLTLSMGFSYGDGNHDEIGKVALLNLNLAEVRGGDQVVVKENDSTKNPVYFGGGSAASTIKRT

RTRTRAMMTASDKIRSVDQVFVVGHKNLDMDALGSAVGMQLFASNVIENSYALYDEEQMSPDIERAVSFIEKEGVTK

LLSVKDAMGMVTNRSLLILVDHSKTALTLSKEFYDLFTQTIVIDHHRRPQDFPDNAVITYIESGASSASELVTELIQPQNS

KKNRLSRMQASVLMAOMMLDTKNFTSRVTSRTFDVASYLRTRGSDSIAIQEIAATDFEEYREVNEULQGRKLGSDVLI

AEAKDMKCYDTVVISKAADAMLAMSGIEASFVLAKNTQOFISLSARSRSKLNVQR1MEELGGGGHFNLAAAQIKDVTLS

EAGEKLTEIVLNEMKEKEKEEZ (SEQ ID. NO. 58)
MKEKNMWKELLNRAGWILVFLLAVLLYQVPLVVTSILTLKEVALLQSGLIVAGLSIVVLALFIMGARKTKLASFNFSFF

RAKDLARLGLSYLVIVGSNILGSILLQLSNETTTANQSQINDMVQNSSIISSFFLLALLAPICEEILCRGIVPKKIFRGKENL

GFVVGTIVFALLHQPSNLPSLLIYGGMSTVLSVIAYKTQRLEMSILLHMIVNGIAFCLLALVVIMSRTLGISVZ (SEQ ID. NO. 59)
MKEKNMWKELLNRAGWILVFLLAVLLYQVPLVVTSILTLKEVALLQSGLIVAGLSIVVLALFIMGARKTKLASFNFSFF

RAKDLARLGLSYLVIVGSNLGSILLQLSNETITANQSQINDMVQNSSLISSPFLLALLAPICEEILCRGIVPKKIPRGKENIL

GFVVGTWFALLHQPSNLPSLLIYGGMSTVLSWAYKTQRLEMSILLHMIVNGIAFCLLALVVIMSRTLGISVZ (SEQ ID. NO. 60)
MDTQKIEAAVKMUEAVGEDANREGLQETPARVARMYQEIFSGLGQTAEEHLSKSFEIIDDNMVVEKDIFFHTMCEHHF

LPFYGRAHIAYIPDGRVAGLSKLARTVEVYSKKPQIQERLNIEVADALMDYLGAKGAFVVIEAEHMCMSMRGVRKPGT

ATUTVARGLFETDKDLRDQAYRLMGLZMKDLFLKRKQAFRKECLGYLRYVLNDHFVLFLLVLLGFLAYQYSQLLQH

FPENHWPILLFVGITSVLLLLWGGTATYMEAPDKLFLLVGEEEIKLHLKRQTGISLVFWLFVQTLFLLLFAPLFLAMGY

GLPVFLLYVLLLGVGKYFHFCQKASKFFTETGLDWDYVISQESKRKQVLLRFFALFTQVKGISNSVKRRAYLDFILKAV

QKVPGKIWQNLYLRSYLRNGDLFALSLRLLLLSLLAQVFIEQAWIATAVVVLFNYLLLPQLLALYHAFDYQYLTQLFPL

DKGQKEKGLQEVVRGLTSFVLLVELVVGLITFQEKLALLALLGAGLVLLVLYLPYQVKRQMQDZ (SEQ ID. NO. 61)
MRKSIVLAADNAYLIPLETTIKSVLYHNRDVDFYILNSDIAPEWFKLLGRKMEVVNSTIRSVHIDKELFESYKTGPHINYA

SYFRFFATEVVESDRVLYLDSDIIVTGELATLFEIDLKGYSIGAVDDVYAYEGRKSGFNTGMLLMDVAKWKEHSIVNSL

LELAAEQNQVVNLGDQSILNIYFEDNWLALDKTYNYMVGIDEYHLAQECERLDDNPPTIVHYASHDKPWNTYSISRLRE

LWWVYRDLDWSEIAFQRSDLNYFERSNQSKKQVMLVTWSADIKHLEYLVQRLPDWHPHLAAPCDCSEELTSLSQYTN

VTVYQNVLHSRIDWLLDDSEVYLDINTGGEVFNVVTRAQESGKICIFAFDITRKSMDDGLYDGIFSVERPDDLVDRMKNI

EIEZ (SEQ ID. NO. 62)
MTKIYSSIAVKKGLFTSFLLFIYVLGSRIILPFVDLNTKDFLGGSTAYLAFSAALTOGNLRSLSIFSVGLSPWMSAMILWQ

MFSFSKRLGLTSTSIEIQDRkKMYLTLLIAVIQSLAVSLRLPVQSSYSAILVVLMNTILLIAGTFFLVWLSDLNASMGIGGSI

VILLSSMVLNIPODVLETFQTVHIPTGHVLLALLTLVFSYLLALMYRARYLVPVNKIGLHNRFKRYSYLEIMLNPAGGMP

YMYVMSFLSVPAYLFILLGFIFPNHSGLAALSKEIMVGKPLWVYVYISVLFLFSIIFAFVTMNGEEIADRMKKSGEYIYGI

YPGADTSRFINRLVLRFSVIGGLFNVIMAGGPMLFVLFDEKLLRLAMIPGLFMMFGGMIFTIRDEVKALRLNETYRPLIZ (SEQ ID. NO. 63)
MSSLSDQELVAKTVEFRQRLSEGESLDDILVEAFAVVREADKRILGMFPYDVQVMGAIVMHYGNVAEMNTGEGKTLT

ATMPVYLNAPSGEGVMVVTPNEYLSKRDAEEMGQVYRFLGLTXGVPFTEDPKKEMKASEKKLIYASDWTTINSNLGPD

YLNDNLASNEEGKFLRPFNYVUDEIDDILLDSAQTPLIIAGSPRVQSNYYAIIDTLVTTLVEGWYIPKEEKEEVWLTTKG

TABLE 2-continued

AKSAENELGIDNLYKEEHASFARHLVYAIRAHKLFTKDKDYHRGNEMVLVDKGTGRLMEMTKLQGGLHQAIEAKEHV
KLSPETRAMASITYQSLPKMFNKISGMTGTGKVAEKEFIETYNMSVVRIPTNRPRQRIDYPDNLYITLPEKVYASLEYIKQ
YHAKGNPLLVFVGSVEMSQLYSSLLFREGIAHNVLNANNAAREAQIISESGQMGAVTVATSMAGRGTDCKLGKGVAEL
GGUVIGTERMESQRIDLQIRGRSGRQGDPGMSKFFVSLEDDVIKKFGPSWVHKKYKDYQVQDMTQPEVLKGRKYRKL
VEKAQHASDSAGRSARRQTLEYAESMNIQRDIVYKERNRLIDGSRDLEDVVVDIIERYTEEVAADHYASRELLFWPIVTN
ISFHVKEVPDYIDVTDKTAVRSFMKQVIDKELSEKKELLNQHDLYEQPLRLSLLKAIDDNWVEQVDYLQQLSMAIGGQS
ASQKNPEVEYYQEAYAGFEAMKEQIHADMVRNLLMGLVEVTPKGEIVTHFPZ (SEQ ID. NO. 64)
MIGTFAAALVAVLANRVPIEITPNSANTEIAPPDGIGQVLSNLLLKLVDNPVNALLTANYIRILSWAVIFGIAMREASKNS
QELLKTIADVTSKIVEWIINLAPFGILGLVFKISDKGVGSLANYGILLVLLVTTMLPVAPVVNPLIAPFFMRRNPYPLVW
NCLRVSGVTAPFTRSSATNTPVNMKLCMDLGLNPDTYSVSIPLOSTINMAGVAITINLLTLAAVNTLGTPVDFATAFVLSV
VAAISSCDASGIAGGSLLUPVACSLFGISNDIAIQIVGVGPVIGVQDSCETALNSSTDVLFTAVAEYAATRKKZ (SEQ ID. NO. 65)
MSISQRTTKLILATCLACLLAYFLNLSSAVSAGIIALLSLSDTRRSTLKLARNRLFSMLLALAIGVLAFHLSGFHIWSLGLY
LAVPLAYKMGWEIGITPSTVLVSHLLVQESTSPDLLVNEFLLFAIGTGFALLVNLYMPSREEEIQHYHTLVEEKDI
LQRFKYYLSRGDGRNRAQLVAELDTLLKEALRLVYLDHSDHLFHQTDYHIHYFEMRQRQSRILRNMAQQINTCHLAAS
ESLILAQLFSKAGQLSQTNPASDLLDEIERYLEVFRNRSLPKTREEPETRATLLQLLREAKTFIQVKVDFYQKYRQZ (SEQ ID. NO. 66)
MEIMSLAIAVFAVIIGLVIGYVSISAKM1SSQEAAELMLLNAEQEATNLRGQAEREADLLVNEAKRESKSLKKEALLEAK
EEARKYREEVDAEFKSERQELKQIESRLTERATSLDRXDDNLTSKEQTLEQKEQSISDRAKNLDAREEQLEEVERQKEAE
LERIGALSQAEARDIILAQTSENLTREIASRIREAEQEVKERSDKMAKDILVQAMQRIAGEYVAESTNSTVHLPDDTMKG
RIIGREGRNIRTFESLTGVDVIIDDTPEVVTLSGFDPIRREIARMTMEMLLKDGRIHPARIEELVEKNRQEIDNKIREYGEA
AAYEIGAPNLHPDLMKIMGRLQPRTSYGQNVLRHSIEVAKLAGIMASELGENAALARRAGFLHDIGKAIDHEVEGSHVE
IGMELARKYKEPPVVVNTIASHHGDVEAESVIAVIVAAADALSAARPGARSESLESYIKRLHDLEEIANGFEGVQTSFAL
QAGREIRIMVNPGKIKDDKVTILAHKVRKKIENNLDYPGNIKVTVIRELRAVDYAKZ (SEQ ID. NO. 67)
MMLKPSIDTLLDKVPSKYSLVILBAKRAHELEAGAPATQGFKSEKSTLRALEEIESGNVTIHPDPEGKREAVRRRIEEEKR
RKEEEEKKIKEQIAKEKEDGEKIZ (SEQ ID. NO. 68)
MSAYQLPTVWQDEASNQGAFTGLNRPTAGARFEQNLPKGEQAFQLYSLGTPNGVKVTILLEELLEAGFKEAAYDLYKI
AIMDGDQFGSDPFKLNPNSKIPALLDQSGTENVRVFESAHILLYLAEKFGAFLPSNPVEKVEVLNWLFWQAGAAPFLG
GGFGHFFNYAPEKLEYPINRFTMEVKRQLDLLDKELAQKPYIAGNDYTIADIAIWSWYGQLVQGNLYQGSAKFLDASS
YQNLVKWAEKANRPAVKRGLEVTYTEIKZ (SEQ ID. NO. 69)
LASLITSIIMFYVGFDVLRDTIQKILSREETVIDPLGATLGIISAAIMFVVYLYNTRLSKKSNSNALKAAAKDNLSDAVTSL
GTAIAILASSFNYPIVDKLVAIIITFFILKTAYDIFIESSFSLSDGFDDRLLEDYQKAIMEIPKISKVKSQRGRTYGSNIYLDIT
LEMNPDLSVFESHEIADQVESMLEERPGVFDTDVHIEPAPIPEDEILDNVYKKLLMREQLIDQGNQLEELLTDDFVYIRQ
DGEQMDKEAYKTKKELNSAIKDIQITSISQKTKLICYELDGIIHTSIWRRMETWQNIFHQETKKEZ (SEQ ID. NO. 70)
MTIKLVATDMDGTFLDGNGRFDMDRLKSLLVSYKEKGIYFAVASGRGFLSLEKLFAGVRDDIIFIAENGSLVEYQGQDL
YEATMSRDFYLATFEKLKTSPYVDINKLLLTGKKGSYVLDTVDETYLKVSQHYNENIQKVASLEDITDDIFKFTTNFTEE
TLEDGEAWVNENVPGVKAMTTGFESIDIVLDYVDKGVAIVELVKKLGITMDQVMAFGDNLNDLHMMQVVGHPVAPE
NARPEILELAKTVIGHHKERSVIAYMHGLZ

TABLE 2-continued (SEQ ID. NO. 71)
MADIKLIALDLDGTLLITTDKRLTDRTKETLQAARDRGIKVVLTTGRPLKAMDFFLHELGTDGQEDEYTITFNGGLVQK
NTGEILDKTVFSYDDVARLYEETEKLSLPLDAISEGTVYQIQSDQELYAKFNPALTFVPVDFEDLSSQMTYNKCVTAFA
QEPLDAAEQKISPELFDQYEIFKSREMLLEWSPKNVHKATGLAKLISHLGIDQSQVMACGDEANDLSMIEWAGLGVAM
QNAVPEVKAAANVVTPMTNDEEAVAWAIEEYVLKENZ (SEQ ID. NO. 72)
MESLLILLLIANLAGLFLIWQRQDRQEKHLSKSLEDQADHLSDQLDYRFDQARQASQLDQKDLEVVVSDRLQEVRKELH
QGLTQVRQEMTDNLLQTRDKTDQRLQALQESNEQRLEQMRQTVEEKLEKTLQTRLQASFETVSKQLESVNRGLDEMQ
TVARDVGALNKVLSGTKTRGALGELQLGQHEDIMTPAQYEREYATVENSSERVEYAIKLPGQGDQEYVYLPIDSKFPLA
DYYRLEEAYETGDKDEIERCRKSLLASVKRFARDIRNKYIAPPRTTNFGVLFVPTEGLYSEIVRNPVFFDDLRREEQIWA
GPSTLSALLNSLSVGFKTLNIQKSADHISKTLASVKTEFGKFGGILVKAQKHLQHASGNIDELLNRRTIAIERTLRHIELSE
GEPALDLLHFQENEEEYEDZ (SEQ ID. NO. 73)
MKISHMKKDELFEGFYLIKSADLRQTRAGKNYLAFTFQDDSGEIDGKLWDAQPHNIEAFTAGKVVHMKGRREVYNNT
PQVNQITLRLPQAGEPNDPADFKVKSPVDVIKEIRDYMSQMIFKIENPVWQRIVRNLYTKYDKEFYSYPAAICTNHHAFET
GLAYHTATMVRLADALSEVYQLNKSLLYAGIMLHDLAKVIELTGPDQTEYTVRGNLLGHIALIDSEITKTVMELGIDDT
KEEVVLLRHVILSHHGLLEYGSPVRPRIMEAEIIHMIDNLDASMMMMSTALALVDKGEMTNKIFAMDNRSFYKPDLDZ (SEQ ID. NO. 74)
MSEKAKKGFKMPSSKTVLLIIIAIMAVLTFIPAGAPIEGIYETQPQNPQGIWDVLMAPIRAMLGTHPEEGSLIKBTSAAID
VAPRLMVGGFLGIVNKTGALDVGIASIVKKYKGREKMLILVLMPLFALGGTTYGMGEETMAFYPLLVPVMMAVGFDS
LTGVAIILLGSQIGCLASTLNPFATGIASATAGVGTGDGVLRLIFWVTLTALSTWFVYRYADKIQKDPTKSLVYSTRKED
LKHFNVEESSSVESTLSSKQKSVLFLPVLTFILMVLSRPWTDLGVTIPDDFNTWLTGLPVIGNIVGSSTSALGTWYFPEG
AMLFAFMGILIGVIYGLKEDKUSSFMNGAADLLSVALIVAIARGIQVIMNDGMITDTILNWGKEGLSGISSQVFIVVTYIF
YLPMSFLIPSSSGLASATMGIMAPLGEFVNVRPSLIITAYQSASGVLNLIAPTSGIVMGALALGRINIGTWWKFMGKLVVA
IIVVTIALLLLGTPLPFLZ (SEQ ID. NO. 75)
MSNSFVKLLVSQLFANLADIFFRVTIIANIYUSKSVIATSLVPILIGISSFVASLLVPLVTKRLALNRVLSLSQFGKTILLAIL
VGMPTVMQSVAPLVTYLFVVAISILDGFAAPVSYAIVPRYATDLGKANSALSMTGEAVQLIGWGLGGLLFATIGLLPTT
CINLVLYIISSFLMLFLPNAEVEVLESETNLEILLKGWKLVARNPRLRLIWSANLLEFSNTIWVSSHLVFVTELLNKTESY
WGYSNTAYSIGIIISGLLRISEKFLAAKWEPQLFTPNLIVFIQNPCLSLDPGWFLFSPNGCFLLDKKEFPLYGISVEKNTK
RKETHMNSLPNHHIQNKSFYQLSFDGGHLTQYGGLIFFQELFSQLKLKERISKYLVTNDQRRYCRYSDSDILVQPLPQLL
TGYGTDYACKELSADAYFPKLLEGGQLASQPRFSRTDEETVHSLRCLNLELVEFFLQPHQLNQLIVDEDSTHFTTY
GKQEGVAYNAHYRAHGYHPLYAFEGKTGYCFNAQLRPGNRYCSEEADSFTTPVLERFNQLLFRMDSGFATPKLYDLIE
KTGQYYUKLKKNTVLSRLGDLSLPCQDEDLTILPHSAYSETLYQAGSWSHKRRVCQFSERKEONLPYDVISLVTNMTS
GTSQDQFQLYRGRGQAENFIKEMKBGFFGDKTDSSTLIKNEVRMMMSCIAYNLYLFLKHLAGGDFQTLTIKRFRML
HVVGKCVRTGRKQLLKLSSLYAYSELFSALYSRIRKVNLNLPVPYEPPRRKASLMMHZ (SEQ ID. NO. 76)
MMEFFQQLPHLEPYGNPQYFVYVIAATLPIFIGLFFKKRFAWYEVLVSLFFIVTMLVGGKTNQLAALGIYLCWEILLLLF
YKHYRKDGKWVFYLVSFLSLLPIIFVKVQPAINGTQSLLGFLGISYLTPRSVGIVIELRDGVIKDPTLWEFLRFLLFMPT
FSSGPIDRFKRFNENYQAIPERDELMDMLDESVRYIMWGFLYKFILAHVLGETLLPPLKNLALQSGGFFNLYALAVMYT
FGLELFFDFAGYSMPALAISNLMGIRSPINFNKPFLSRDLKEFWNRWHMSLSFWFRDFVPMRMVMVLTRKKVFKNRN

TABLE 2-continued

VTSSMAYIVNMLMGFWHGVTWYYIAYGLFHGLGLVINDAWVRKKKTLNKERKKAGKAALPENRWIQLLGMVVTFH
VVMLSFLIFSGFLNNLWFKKZ (SEQ ID. NO. 77)
MLKRLWMIFGPVLIAGLLVFLLIFFYPTEMHHNLGAEKRSAVATTIDSFKERSQKVRALSDPNVRFVPFFGSSEWLRFD
GAHPAVLAEKYNRSYRYLLGQGGAASLNQYFGMQQMLPQLENKQVVYVISPQWFSKNGYDPAAPQQYPNGDQLTS
FLKHQSGDQASQYAATRLLQQPPNVAMKDLVQKLASKEELSTADNEMIELLARFNERQASFFGQFSVRGYVNYDKHV
AKYLKILPDQPSYQAIEDVVKADAEKTSNNEMGMENYPYNEQIKKDLKKLKDSQKSPTYLKSPEYNDLQLVLTQFSK
SKVNPIFIIPPVNKKWMNYAGLREDMYQQTVQKIRYQLESQGFTNIADFSKDGGEPFFMKDTIHLGWLGWLAFDKAVD
PFLSNPTPAPTYHLNERFFSKDWATYDGDVKEFQZ (SEQ ID. NO. 78)
MEKNLKALKQTTDQEGPAIEPEKAEDTKTVQNGYFEDAAVKDRTLSDYAGNWQSVYPFLEDGTFDQVFDYKAKLTG
KMTQAEYKAYYTKGYHTDVTKINITDNTMEFVQGGQSKKYTYKYVGKKILTYKKGNRGVRFLFEATDADAGQFKYV
QFSDHNVAPVKAEHFHIFFGGTSQEALFEEMDNWPTYYPDNLSGQEIAQEMLAHZ (SEQ ID. NO. 79)
MKDGHLLAHHIRLLNGRIFQKLLSQDPEALYRGEQGKILAVLWNSETGCATATDIALATGLANNTLTTMIKKLEEQKL
VIVSPCGKDKRKKYLVLTELGKSQKEVGHRVSQKLDTIFYKGFSEEEIHQFEGFQERILANLKEKGNEVZ (SEQ ID. NO. 80)
MTNLIATFQDRFSDWLTALSQHLQLSLLTLLLAILLAIPLAVFLRYHEKLADWVLQIAGIFQTIPSLALLGLFIPLMGIGTL
PALTALVLYAIFPILQNTGLKGIDPNLQEAGIAFGMTRWERLKIFEIPLAMPVIMSGIRTAAVLIGTATLAALIGAGGL
GSPILLGIDRNNASLILIGALSSAVLAIAFNFLLKVMEKKLRTSGFALVALLLGLSYSPALLVQKEKENLVIAGKIGPEP
EILANMYKLLIEENTSMTATVKPNPGKTSFLYEALKKGDIDIYPEETGTVTESLLQPSPKVSHEPEQVYQVARDGIAKQD
HLAYLICPMSYQNTYAVAVPKKIAQEYGLKTISDLKKVEGQLKAGFTLEFNDREDGNKGLQSMYGLNLNVATIEPALRY
QAIQSGDIQITDAYSTDAELERYDLQVLEDDKQLFPPYQGAPLMKEALLKKHPELERVLNTLAGKITESQMSQLNYQVG
VEGKSAKQVAKEFLQEQGLLKKZ (SEQ ID. NO. 81)
MMHTYLQKKIENIKTTLGEMSGGYRRMVAAMADLGFSGTMKAIWDDLPAHRSFAQWIYLLVLGSFPLWLELVYEHRI
VDWIGMICSLTGIICVIFVSEGRSNYLFGLINSVIYLILALQKGFYGEVLTTLYFTVMQPIGLLVIYQAQFKKEKQEFV
ARKLDGKGWTKYLSISVLWWLAFGFIYQSIGANRPYRDSITDATNGVGQILMTAVYREQWIFWAATNVFSIYLWWGES
LQIQGKYLIYLINSLVGWYQWSKAAKQNTDLLNZ (SEQ ID. NO. 82)
MRNMKAKYAVWVAPFLNLTYAIVEFIAGGVFGSSAVLADSVHDLGDAIAIGISAFLETISNREEDNQYTLGYKRFSLLG
ALVTAVILVTGSVLVILENVTKILHPQPVNDEGILWLGILTINLLSLVVGKGKTKNESILSLHFLEDTLGWVAVILMAI
VLRFTDWYILDPLLSLVISFFILSKALPRFWSTLKIFLDAVPEGLDIKQVKSGLERDNVASLNQLNLWTMDALEKNAIV
HVCLKEMEHMETCKESIRIFLKDCGFQNITIEIDADLETHQTHKRKVCDLERSYEHQHZ (SEQ ID. NO. 83)
MIEYKNVALRYTEKDVLRDVNLQIEDGEFMVLVGPSGSGKTTMLKMINPLLEPTDGNIYMDGKRIKDYDERELRLSTG
YVLQAIALIPNLTVAENIALIPEMKGWSKEEITKKTEELLAKVGLPVAEYGHRLPSELSGGEQQRVGIVLRAMIGQPICIFL
MDEPFSALDAISRKQLQVLTKELIEFGMTTIFVTHDTDEALKLADRJAVLQDGEIRQVANPETILKAPATDFVADLPG
GSVHDZ (SEQ ID. NO. 84)
MSAVAISAMTKVMQETHGNPSSIHGHGRQAGKLLREARQELAQLLRTKPQHIFFTSGGTEGNNTTIIGYCLRHQEQGKH
IITTAIEHHAVLETIDYLVQHFGFEATIIQPENQEITAQQIQKALRDDTILVSTMFVNNETGNLLPIAEIGQILKQHPAAYH
VDAVQAIGKIPHSEELGIDFLTASAHKFHGPKGIGFLYASSMDFDSYLHGGDQEQKRAGTENLPAIVGMVAALKEDL

TABLE 2-continued

EKQEEHFQHVQNLETAFLAELEGIQYYLNRGKHHLPYVLNIGFPGQKNDLLLLRLDLAGISTGSACTAGVVQSSHVLE

AMYGANSERLKESLRISLSPQNTVEDLQTLAKTLKEUGGZ (SEQ ID. NO. 85)
MLFKLSKEKIELGLSRLSPARRIFLSFALVILLGSLLLSLQFVQVESSRATYFDHLFTAVSAVCVTGLSTLPVAHTYNIWG

QIICLLLIQIGGLGLMTFIGVFYIQSKQKLSLRATIQDSFSYGSLRFVYSIFLTTFLVESLGAILLSFRLIPQLGWGR

GLFSSIFLAISAFCNAGPDNLGSTSLFAFQTDLLVNLVIAGLIITGGLGPMVWFDLAGHVGRKKKGRLHFHTKLVLLLTI

GLLLFGTATTLFLEWNNAGTIGNLPVADKVLVSFFQTVTMRTAGFSTIDYTQAHPVTLLIYILQMFLGGAPGGTAGGLK

ITTFFVLLVFARSELLGLPHANVARRTIAPRTVQKSFSFIIFLMSFLIGILLGITAKGNPPFIHLVFETISALSTVGVTANL

TPDLGKLALSVIMPLMFMGRIGPLTLFVSLADYXPEKKDMIHYMKADISIGZ (SEQ ID. NO. 86)
MSDRTIGILGLGIFGSSVLAALAKQDMNIIAIDDHAERINQFEPVLARGVIGDITDEELLRSAGIDTCDTVVVATGENLESS

VLAVMHCKSLGVPTVIAKVKSQTAKKVLEKIGADSVISPEYEMGQSLAQTILFHNSVDVFQLDKNVSIVEMKIPQSWAG

QSLSKLDLRGKYNLNILGFREQENSPLDVEFGPDDLLKADTYILAVINNQYLDTLVALNSZ (SEQ ID. NO. 87)
MKLLSIAISSYNAAAYLHYCVESLVIGGEQVGILIINDGSQDQTQEIAECLASKYPNIVRAIYQENKCHGGAVNRGLVEAS

GRYFKVVDSDDWVDPRAYLKILETLQELESKGQEVDVFVTNFVYEKEGQSRKKSMSYDSVLPVRQIFGWDQVGNFSK

GQYTMMHSLIYRTDLLRASQFZ (SEQ ID. NO. 88)
MKFNPNQRYTRWSRRLSVGVASVVVASGFFVLVGQPSSVRADGLNPTPGQVLPEETSGTKEGDLSEKPGDTVLTQAKP

EGVTGNTNSLPTPTERTEVSEETSPSSLDTLPBKDEEAQKNPELTDVLXETVDTADvDGTQASPAERRPEQVKGGVKEN

TKDSIDVPAAYLEKAEGKGPFTAGVNQVIPYELFAGDGMLTRLLLKASDNAPWSDNGTAKNPALPPLEGLTICGKYFYE

VDLNGNTVGKQGQAUDQLRANGTQTYKATVKVYGNKDGKADLTNLVATKNVDININGLVAKETVQKAVADNVKDSI

IDVPAAYLEKGEGPTAGVNHVIPYELFAGDGMLTRLLLLSDKAPWSDNGDAKNPALSPLGENVKTKGQYFYQV

ALDGNVAGKEKQALIDQFRANGTQTYSATVNVYGNKDGKPDLDNIVATKKVTLNNGLSKETVQKAVADNVKDSIDV

PAAYLEKAKGEGPFTAGVNHVIPYELFAGDGMLTRLLLKASDKAPWSDNGDAKNPALSPLGENVKTKGQYFYQLALD

GNVAGKEKQALIDQFRANGTQTYSATVNVYGNKDGKPDLDNIVATKXVTININGLISKETVQKAVADNVKTVSMFQQPTZ (SEQ ID. NO. 89)
MKLKSYILVGYIISTLLTILVVFWAVQKMLIAKGEIYFLLGMTIVASLVGAGISLFLLLPVFTSLGKLKEHAKRVAAKDFP

SNLEVQGPVEFQQLGQTFNEMSHDLQVSFDSLEESEREGLMIAQLSHDIKTPITSIQATVEGILDGIIKESEQAHYLATIG

RQTERLNKLVEELNFLTLNTARNQVETTSKDSIFLDKLLIECMSEFQFLIEQERRDVHLQVIPESARIEGDYAKLSRJLVN

EITVSSQYGLGSTETLVLNLSGSENKAZ (SEQ ID. NO. 90)
MFGQTAQHGLTNSLKDFWIFLLNIGPQLAFFCQMLRCSRSVEQGTGNHRREFNMIQQIFSHFGMTHLGQIKLVYQESID

LELLVNALNHHLLIDRLVLTPNQITIEIDRQIVHGLDLLKGRXDKEIIDIKSMFRQLELASTQQICPNQRVHHGILAFGEIS

DLVPAKNLPNRQDZ (SEQ ID. NO. 91)
MEHLATYPSTYGGAPAALGWLAVGLSGMGSAYGVGKAGQSAAALLKEQPEKFASALILQLLPGTQOLYGFVIGLIW

LQLTPSLPLEKGVAYFVALPIA1VGYFSAKHQGNVAVAGMQILAKRPKEFMKGAILAAMVETYAILAIWVSFILTLRVZ (SEQ ID. NO. 92)
MLKSEKQSRYQMLNEELSFLLEGETNVLANLSNASALIKSRFPNTVFAGFYLFDGKELVLGPFQGGVSCIIRIALGKGVC

GEAAGHFQETVIVGDVTTYLNYISCDSLAKSEIVVPMMKNGQLLGVLDLDSSEIEDYDAMDRDYLEQFVAILLEKTAWD

FTMFEEKSZ

TABLE 2-continued (SEQ ID. NO. 93)
MSVLEKDLHVEIEGKEILKGVNLTLTGEAAIMGPNGTGKSAAIMGNPNYEVTKGEVLFDGVNILELEVDERAR

MGLFLAMQYPSEIPGITNAEFLRAAMNAGKEDDEKISVREFITKLDEKMELLNMKEEMAERYLNEGFSGGEKKRNEIL

QLLMLEPTFALLDEIDSGLDIDALKVVSKGVNAMRGEGFGAMIITTHYQRLLNYITPDVVHVMMEGRVVLSGGPELAAR

LEREGYAKLAEELGYDYKEELZ (SEQ ID. NO. 94)
MPYKRQRSFSMALSKLDSLYMAVVADHSKNPHHQGKLEDAEQISLNNPTCGDVINLSVKFDAEDRLEDIAFLNGCTIS

TASASMMTDAVLGKKQEILELAT1FSEMVQGQKDERQDQLGDAAGVAKFPQPJKCATWNALKIENQEKQZ (SEQ ID. NO. 95)
MKIQDLLRKDVMLLDLQATEKTAVIDEMIKNLTDHGYVTDEFETFKEGILAREALTSTGLGIAMPHSKNAAVKEATV

LFAKSNKGVDYESLDGQATDLFFMIAAPEGANDTHLAALAELSQYLMKDGFADKLRQATSADQVIELFDQASEKTEEL

VQAPANDSGDFIVAVTACTTGIAHTYMAQEALQKVAAEMGVGIKVETNGASGVGNQLTAEDIRKAKAIIIAADKAVEM

DRFDGKPLINRPVADGIRKTEELINLALSGDTEVYRANGAJ(AATASNEKQSLGGALYLMSGVSQMLPFVIGGGIMI

ALAFLIDGALGVPNENLGNLGSYHELASMFMKIGGAAFGLMLPVFAGYVAYSIAEKPGLVAGFVAGALAKEGFAFGKIP

NDFLGGLGGGSAVLLGIVLGGMMAVDMGGPVNKAAYVFGTGTLAATVSSGGSVAMAAVMAGGMVPPLAIFVATLLF

VLVGAIVSGVVYGYLRKPQAZ (SEQ ID. NO. 96)
MANKNTSTTRRRPSKAELERKEAIQRMLISLGIAILLIFAAFKLGAAGITLYNLIRLLVGSLAYLAIFGLLIYLFFFKWIRK

QEGLLSGFFTIFAGLLLIFEAYLVWKYGLDKSVLKGTMAQVVTDLTGFRTTSFAGGGLIGVALYPTAFLFSNIGTYFIGS

LILVGSLLVSPWSVYDIAEFSRGFAKWWEGHERRXEERFVKQEEKARQKAEKEARLEQEETEKALLDLPPVDMETGE

ILTEEAVQNLPPIPEEKWVEPEIILPQAELKFPEQEDDSDDEDVQVDFSAKEALEYKLPSLQLFAPDKPKDQSKEKKWRE

NIKILEATFASFGIKVTVERAEIGPSVTKYEVKPAVGVRVNRISNLSDDLALALAAKDVRIEAPIPGKSUGTEVPNSDIATV

SFELWEQSQTKAENFLEIPLGKAVNGTARAFDLSKMPHLLVAGSTGSGKSVAVNGIIASILMKARPDQVKFMMVDPK

MVELSVYNDIPILLJPVVTNPRKASKALQKVVDEMENRYELFAKVGVRNIAGFNAKVEEFNSQSEYKQIPLPFIVVIVDE

LADLMMVASKBVEDAIIRLGQKARAAGIHMILATQRPSVDVISGUKANVPSRVAFAVSSGTDSRTLDNGAEKLLGRG

DMLFKPIDENHPVRLQGSFISDDDVERIVNPIKTQADADYDESFDPGEVSENEGEFSDGDAGGDPLFEEAXSLVIETQKA

SASMIQRRLSVGFNRATRLMEELEIAGVIGPAEGTKPPJCVLQQZ (SEQ ID. NO. 97)
MSYFKKYKFDKSQFKLGMRTKTGIAVFLVLLIFGFGWKGLQIGALTAVFSLRESFDESVHFGTSRILGNSIGGLYALV

FLLNTFFWEAWVTLVVVPICTMLTIMTNVAMNNCAGVIGGVAAMLHTLSPSGETILYVFVRVLETFMGVFVAUVN

YDIDRIRLFLEKKEKZ (SEQ ID. NO. 98)
MNKSEHRHQLIRAUTKNKIHTQAELQALLAENDIQVTQATLSRDIKNMNLSKVREEDSAYYVLNNGSISKWEKRLELY

MEDALVWMRPVQHQVLLKTLPGLAQSFGSHDTLSFPDAATLCGNDVCLIICEDADTAQKCFEELKKFAPPFFFEEZ (SEQ ID. NO. 99)
MCSIKLNALSYMGRVLNIFPItTGTYVARVLDRTDYGYFNSVDTILSFFLPFATYGVYNYGLRAISNVKDNKKDLNRT

FSSLFYLCIACTILTRAVYILAYPLFFTDNPIVKKVYLVMGIQLIAQFSIEWVNBALENYSILFYKTAFRILMLVSIFLPVK

NEHDEVVYTLVMSLTLINYLSYFWKRDIKLVKIHLSDFKPLFLPLTAMLVANANMLFTTLDRLFLVICTGIDVNVSY

AQRJVTVIAGVVTGAIGVSVPRLSYYLGKGDKEAYVSLVNRCSRIFNPFHPLSFGLMVLGNAILLYGSEKYIGGGIL

TSLFAFRTULALDTILGSQILFTNGYHKRTVYTVFAGLLNLGLNSLLFFNHVAPEYYLLTRMLSETSLLVFYIIFEHRKQL

IHLGHIFSYTVRYSLFSLSWAIYFUNFVYPVDMVINLPFLINTGLIVLLSAISYISLLVFRKDStFYEFLNHVLALKNKFKK

SZ

TABLE 2-continued (SEQ ID. NO. 100)
MELFMKITNYEIYXLKKSGLTNQQILICVLEYGENVDQELLLGDIADISGCRNPAVFMERYPQIDDAHLSKEFQKFPSPSIL
DDCYPWDLSEIYDAPVLLFYKGNLDLLKFPKVAVVGSRACSKQGAKSVEKVIQGLENELVIVSGLAXGDTAAHMAAL
QNGGKTAVIGTGLDVFPKANKRLQDYIGNDHLVLSEYGPGEQPLKHFPARNRIAGLCRGVIVAEAKMRSGSLTCE
RAMEEGRDVFAIPGSILDGLSDGCIIMLIQEGAKLVTSGQDVLAEFEPZ (SEQ ID. NO. 101)
MKQLTVEDAKQIELEILDYIDTLCKKIININYIINYGTLIGAVRHEGFIPWDDDIDLSMPRBDYQRFINIFQKEKSKYKLLS
LERDKNYNNFIKTDSTRKIIDTRNTKTYESGIIDIFPDRFDDPKVIDTCYKESKLLSFSKHKNWYKDSLLKDWIRT
AFWLLLRPVSPRYFANKIEKEIQKYSRENGQYMAFIPSKFKEKEVFPSGTFDKTIDLPPENLSLPAPEKPDTILTQFYGDY
MTLPPEEKRFYSHEFHAYKLEDZ (SEQ ID. NO. 102)
MIKINHLTITQNKDLRDLVSDLTMTIQDGEKVAIIGEEGNGKSTLLKLMGEALSDFTIKGNIQSDYQSLAYPQKVPEDL
KKKTLHDYFFLDSIDLDYSILYRLAEELHFDSNRFASDQEIGNLSGGEALKIQLIHELAICPFEILFLDEPSNDLDLETVDW
LKGQIQKTRQTVTFISHDEDPLSETADTIVLRLVKHRKEAETHVEHLDYDSYSEQRKANFAKQSQQAANNQRAYDKT
MEKIRRVKQNVETALRATKDSTAGRLLAKKMKTVLSQEKRYEKAAQSMTQKPLEEEQIQLFFSDIQPLPASKVLVQLE
KENLSIDDRVLVQKLQLTVRGQEKIGIIGPNGVGKSTLLAKLQRLLNDKREISLGIMPQDYHXJCLQLDLSPIAYLSKTGE
KEELQKQSHLASLNFSYPMQHQRSLSGGQQGKLLLLDLVLRKPNFLLLDEPTRNPSPTSQPQIRKLFATYPGGLITVS
HDRRFLKEVCSIIYRMTEHGLKLVNLEDLZ (SEQ ID. NO. 103)
MKPKTFYNLLAEQNLPLSDQQKEQFERYFELLVEWNEKINLTAITDKEEVYLKNFYDSIAPILQGLIPNETIKLLDIGAGA
GFPSLPMKILYPELDVTIIDSLNKRINFLQLLAQELDLNGVHFYHGRAEDFAQDKNFRAQYDFVTARAVARMQVLSELT
IPYLKVGGKLLALKASNAPEELLEAKNALNLLFSKVEDNLSYALPNRDPRYITVVEKKKETPNKYPRKAGMPNKRPLZ (SEQ ID. NO. 104)
MSIKUAVDIDGTLVNSQKEITPEVFSAIQDAKEAGVKVVIATGRPIAGVAICLLDDLQLRDEGDYVVTFNGALVQETATG
HEIISSLTYEDYLDMEFLSRKLGVHMHAITKDGIYTANRNIGKYTVHESTLVSMPYRTPEEMAGKJVKCMFIDEPEI
PEIKKIAKYITKTNDESGVAHAIRTWVLZ (SEQ ID. NO. 105)
MTWIILGVIALIVIIVSYNGLVKNRMQTKEAWSQIDVQLKRRNDLLPNLIETVKGYAYEGLEKVAELRNQV
TSPAEAMKASDALTRQVSGIFAVAESYPDLKASANPVICLQEELTNTENKSYSRQLYNSVVSNYNVKLETFSNIIAGMF
GFKAADFLQTPEEEKSVPKVDPSGLGDZ (SEQ ID. NO. 106)
MLFDQIASNKRKTWILLLVFFLLLALVGYAVGYLIRSGLGGLVIALIIGFIYALSMIFQSTEVMSMNGAREVDEQTAPD
LYHVVEDMALVAQIPMPRVFIIDDPALNAFATGSNPQNAAVAATSGLLAIMNREELEAVMGHEVSHIRNYDIRISTIAV
ALASAITMLSSMAGRMMWWGGAGRRRSDDDRDGNGLEIIMLVVSLLAIVLAPLAATLVQLAISRQREFLADASSVELT
RNPQGMINALDKLDNSKPMSRHVDDASSALYINDPKKGGGFQKLFYTHPPtSERIERLKQMZ (SEQ ID. NO. 107)
MKLNIQEIRKQSEGLNFEQTLDLVDDLRARNQEILDVKDILAVGKVQYEDRMYFLDYQLSYTIVLASSRSMEPVELVES
YPVTEVFMEGATNQLDQEVLDDDLVLPIENGELDLAESVSDNLLNIPIKVLTAEEBAGQCPISGNDWQIMTEEEYQAQ
KAVKKEENSPFAGLQGLFDGDEZ (SEQ ID. NO. 108)
MKRQLALVVPSGGQDSRTCLWVMQHYETVEAVTFAYGQRMHLEQRRREIAKEQGRHHILDMSLLGQITAQPDFATI
HSYIPDKLCVESKSLKLYLFSYRNHGDFHENCNTIGKDLVNLLDPRYLEVWGKFTPRGGISDPYYNYGKQGTKYEGL
AEQRLFQHDLYPEKIDNRZ TABLE 2-continued (SEQ ID. NO. 109)
MTETVEDKVSHSnGLDILKGIVAAGAVISGTVATQTKVFTNESAVLEKTVEKTDALATNDTVVLGTISTSNSASSTSLSA
SESASTSASESASTSASESASTSASTSISASSTVVGSQTAAATEATAKXVEEDRKKPASDYVASVTNVNLQSYA
gRRKRSVDSIEQLLASIKNAAVSGNTVNGAPAINASLNLAKSETKVYTGEGVDSVYRVPIYYKLKVTNDGSKLTFTYT
VTYVNPKTNDLGNISSMRPGYSYNSGTSTQTMLTLGSDLGKPSGVKNYITDKNGRQVLSYNTSTMTRQGSGYTWGNG
AQMNGFFAKXGYGLTSSWTVPITGTDTSFTFTPYAARTDRIGINYFNGGGKVVESSITSQSLSQSKSLSVSASQSASASAS
TSASASASTSASASASTSASASASTSASASASTSASVSASTSASASASTSASASASTSASESASTSASASASTSASASASTSASESASTSASE
SASTSASASASTSASESASTSASASASAST-
SASASASASTSASGSASTSTSASASTSASASASTSASASASISASESASTSASESASTST
SASASTSASESASTSASASASTSASASASTSASASASTSASASTSASESASTSASASASTSASASASTSASASASTSASASASTS
ASVSASTSASASASTSASASASTSASESASTSASASASTSASASASTSASASASTSASESASTSASASASTSASESASTSASASA
STSASASASTSASGSASTSTSASASTSA-
SASASTSASASASISASESASTSASESASTSTSASASTSASESASTSASASASTSASA
SASTSASASARQVRRPQPVHLNRMQPVRQPQQVLVHQLQHQRVHRLQHPVPRLQRQPVRQLQQVPVLQSQHQQVLQ
PQHRQVPRLQQAHQHLNQRRQAPQLQQVPVRQPQRRQVRQPQQVLVHQLQHQRVHRLRRQPVHQSQQVPVRQLPHQ
QVPRLQQAPVRRLQQVLAPQPQPQPVRQPQQVSQRLNRIIQRVRPLQQVLAPQPQRQQVHRLQRQRVRLNRHQRVRPL
QQVLAPQPQRQQVHRLQHQRVRPLQQVLAPQPQRQQVHRLQRQRVRLSQHQRVRQPQQAHQLLNLHQPVRQPQHRQ
APQLQQVPVRQPQRRQVRRLQQVPVRQPQQVPVRQPQRRQVRRPQPVHLNRNQPVRQPQQVLVHQLQMQRVHRLQH
QPVHQSQQVPVRQPRINKCLGFSKYZ (SEQ ID. NO. 110)
MGVETWFYSSICWLALGLGSVWKFPYMTAANGGGGFLLIFLLSTILIGPLLLAEALGRSAGVSAIKTFGKLGKNNKYN
IGWIGAFALFLLSFYSVIGGWTLVYLGIEFGKLFQLGGTGDYAQLFTSfLSNPAIALGAQAAPILLNIFIVSRGVQKGIERA
SKVMMPLLFIVFVFIIGRSLSLPNAMEGVLYPDSKLTSTGLLYALGQSFALSLGVTVMLTYASYLDKXTNLVQSG
ISIVAMNISISIMAGLAFQARSPFNQSEGGPSLLVLPQLIDKMPFGTUYVLFLLLFLFATVTFSVVMLEINVDNITNQD
NSKRAXWSVILGLTFVFGTPSALSYGVMADVHIFGKTFFDAMDFLVSNLLMPFGALYLSLTGYTFKKALAMEELHLD
ERAWKQGLFQVWLFLLRFFVSSFQSSSLWSSLPNLCNQKGLEZ (SEQ ID. NO. 111)
MLKKWQLKDVILLAFLSIFFC3GVFVGSGYVYNELSLLLTPLGLQAFANEILFGLWCMAAPIAAIFVPRVGSATIGEVLAA
LAEVLYGSQFGLGALLSGFVQGLGSEFGFIVTKNRYESWLSLTANSIGITLVSFVYEYIKLGYYAFSLPFVLSLLVVRFISV
YFFCTILVRAIVKLYHQFATGGKAZ (SEQ ID. NO. 112)
MVKVATQTPHSLLLILSLETSFIPSIALTLSVVAPCILFMLYYRRFKMLAWMLLLAILPSFANYWAVQLHGDASQAVML
GTRAFVTVCIGLVFVSSVSLKELLLYLAQKGLSRSWSYALIVVFNSFPLQQEIKSLKEACLLRGQELHFWSPLIYSKVLM
TVFRWRHLYLRALSAHGYDEHAQLKNSYRTFYPKKTKLIYLLFFLLLQTSLLZ (SEQ ID. NO. 113)
MRKHQLQVHKLTLSMMALDVVLTPRIEGMAPMSSVVNLAGIMMGPVYALAMATVRAFXRNfFRQGIPPLALTGAT
FGALLAGLFYKYGRKFHYSALGEILGTGUGSIVSYPVMVLFTGSAAKLSWFEYTPREFGATLIGTALSFIAFRFLKQEFFK
KVQGYFFSERIDZ (SEQ ID. NO. 114)
MQETNPFPIGSSSLIHCFLNEISCEMLANGILALGCKPVMADDSREVLDFIKQSQALNLGHLSAEKEKJJRMAASYAN
QSSLPMVVDAVGVRSSIRKSLVKDLLDYRPRVLKGNMSEIRSLVGLKHHGVGVDASAJCDQETEDLLQVLKDWCQTYP
GMSFLVTGPKDLVVSKNQVAVLGNGCTELDWITGTGDLVGALTAVFLSQGKTGPEASCLAVSYLNIAAEKIVVQOMG
LEEFRYQVLNQLSLLRRDENWLDTIKGEVYEZ TABLE 2-continued (SEQ ID. NO. 115)
MNHKAILSDVMGNATALEAVL&DAXNQGASEYWLLGDIFLPGPGANDLVALLKDLPPASVRGNWDDRVLEALDGQ
YGLEDPQEVQLLRMTQYLMERMDPATIVWLRSLPLLEKKEIDGLRFSISHNLPDKNYGGDLLVENDTEKFDQLLDAET
DVAVYGHVHKQLLRYGSQGQQIINPGSIGMPYFNWEALKNHRSQYAVIEVEDGELLNIQFRKVAYDYEAELELAKSKG
LPFIEMYEELRRDDNYQGHNLELLASLIEKHGYVEDVKNFFDFLZ (SEQ ID. NO. 116)
MNVQIVRIIPTLKANNRKLNETFYIETLGMKALLEESAFLSLGDQTGLEKLVLEEAPSMRTRKVEGRKKLARLIVKVE
NPLEIEGTTDSIHRLYKGQNGYAFEIPSPEDDLILIHAEDDIASLVEVGEKPEQTDLASKEISMELHLDIF
LESSEIGASLDFIPAQGQDLTVDNTVTWDLSMLKFLVNELDLSLRQKFESTEYFIPKSEKGKDNVELWEVZ (SEQ ID. NO. 117)
MKWTKHIIKKIEEQIEAGIYPGASFAYFKDNQWTEFYLGQSDPEHGLQTEAGLVYDLASVSKVVGVGTVCTFLWEIGQLD
IDRLVIDFLPESDYPDTIRQLLTRATDLDPPIPNRDLLTAPELKEAMFHLNRSQPAFLYSDVHPLLLGFLEFNQDLD
VILKDQVWKPWGMTETKFGPVELAVPTVRGVEAGIVHDPKARLLGREAGSAGLFSTIKDLQIFLEHYLADDFALNQ
NFSPLDDKERSLAWNLEGDWLDHTGYTGTFIMWNRQKQEATFLSNRTYEKDERAQWILDRNQVMNLIEEZ (SEQ ID. NO. 118)
MMKKTYNHILVWGVIFYSICIVCFCFTPQEQSTVGVGTPGIQHLGRLVFLLTPFNSLWKLGEVSDIGQLCWIFLQNILNV
FLFFPLIFQLLYLFPNLRKTKKVLLFSFLVSLGIECTQLILDFFFDFNRVFEIDDLWTNTLGGYLAWLLYKRLHKVRN
Z (SEQ ID. NO. 119)
MKIPLLTFLARHKFVYVLLTLLFLALVYRDVLMYFFDIHAPDLAKFDGQAIKNDLLKSALDFRILQNLGQSFIIPIII
VLLGFQYIELKNXVLRLSRBVSYQGLKRKLTLQVASIPCLIYLVTVLUAHTYFFGTFSPLGWNSLSDGSGLQRLLDGE
IKSYLFFTCVLLIGIFINAIYFLQIVDYVGNVTRSAITYLMFLWLGSMLLYSALPYYMVPMTSLMQASYGDVSLMKLP
YILYIVPYMVLEICYEDNVZ (SEQ ID. NO. 120)
MFKVLQKVGKAFMLPIAILPAAGLLLGLGGALSNPRTIATYPILDNSIFQSIFQVMSSAGEVVFSNLSLLLCVGLCIGLAKR
DKGTAALAGVTGYLVMTATUALVKLFMAEGSAIDTGVIGALVVGIVAVYLHNRYNNIQLPSALGGGSPPISF
SSILIGFVFFVWPPFQQLLVSTGGYSQAGPIGTLYGFLMRLSGAVGLHHIIYPMTYTELGGVETVAGQTVGAQKI
PAQLADLAHSGLFREGTREAGRFSTMMFGLPAACLAMYHSVPKNRRKKYAGLFGVALTSFITGITEPIEFMFLPVSPV
LYVHAFLDGVSPFIADVLNISIGNTFSGGVIDFRLFGILQGNAKTNWVLQIPGLIWSVLYYIIFRWFTQNVLTRGE
EVDSKEISESADSTSNTADYLKQDSLQIIRALGGSNNIEDVDACVTRLRVAVEVNQVDKALLKQIGAVDVIEVKGGIQ
AIYGAKAILYKNSINEILGVDDZ (SEQ ID. NO. 121)
MKFRKLACVLAGAAVLGLAACGNSGGSKDAAKSGGDGAKTEITWWAFPVFTQEKTGDGVGTYEKSUEAFEKANPDI
KVKLETDFKSGPEKNTAIEAGTAPDVLFDAPGRIIQYGKNGKLAELNDLFTDEFVKDVNNENRVQASKAGDKAYMYPI
SSAPFYMAMNKKMLEDAGVANLVKEGWITDDFEKVLKALKDKGYTPGSLFSSGQGGDQGTRAFISNLYSGSVTDEKV
SKYTRDDPKFVKGLEKATSWIKDNLINNGSQFDGGADIQNFANGQTSYTILWAPAQNGIQAKLLEASKVEVVEVPFPSD
EGKPALEYLVNGFAVNNKDDKKVAASKKIQFIADDKEWGPKDVVRTGAFPVRTSFGKLYEDKRMETSGWTQSP
YYNTIDGFAEMRTLWPMLQSVSNGDEKPADALKAFTEKANETIKKAMKQZ (SEQ ID. NO. 122)
MQSTEKKPLTAFTVISTIILLLLTVLFIPPFYWILTGAFKSQPDTIVIPPQWFPKMPTMENFQQLMVQNPALQWMWNSVFI
SLVTMFLVCATSSLAGYVLAKKRFYGQRILFAIFIAAMALPKQVVLVPLVRIVNFMGHDTLWAVILPLIGWPFGVFLM
KQFSENIPTELLESAKIDGCGEIRTFWSVAPPVKPGFAALAIPTFINTWNDYFMQLVMLTSRNNLTISLGVATMQAEMA
TNYGLMAGAALAAVPIVTVFLVFQKSTQGITMGAVKGZ TABLE 2-continued (SEQ ID. NO. 123)
MKIMFKNFNNILLNRCIVLLLRIVLMMILINHLLSTAVQKQDAVIFFKRELSFSYNDYSEANLEIPICLLLNLSIFMVGW

LSVILLESDLADHYHHLIRYQSSSFFDYTRKRLVVISKFFTQDLFVWFLGLLPLGIHFKTVALFFLLAQLMMLYLLLSYU

ALISAGAGFSFFLYPLAFVGQEWMMDHIVTVYLVLLSLLVMLVSRLESKFKKGZ (SEQ ID. NO. 124)
MGKGEMGKGVIGLEFDSEVLVNKAPTLQLANGKTATFLTQYDSICTLLPAVDKEDIGQEIIGIAKGSIESMHNLPVNLAG

ARVPGVNGSKAAVHEVPEFTGGVNGTEPAVHEIAEYKGSDSLVTLTTGKDYTYKAPLAQQALPETGNKESDLLASLG

LTAFLGLFTLGKXREQZ (SEQ ID. NO. 125)
MKKTFFLLVLGLFCLLPLSVIAIDFKINSYQGDLYIHADNTAEFRQKIVYQFEEDFKGQIVGLGRAGKMPSGFDIDPHPKI

QAAKNGAELADVTSEVTEADGYTVRVYNPGQEGDIVEVDLVWNL,KNLLPLYDDIAELNWQPLTDSSESIEKFEFHVR

GDKGAEKLFFTGKLBGTIEKSNLDYTIRLDNLPAKRGVELHAYWPRTDFASARDQGLKGNRLEENKIEDSIVREK

DQSKQLVTWVLPSILSISLLLSVCYFIYRRKTRPSVKYAKNHRLYEPPMELEPMVLSEAVY5TSLEEVSPLVKGAGKFTF

DQLIQATLLDVIDRGNVSIISEGDAVGLRLVKEDGLSSFEKDCLNLAFSGKICEETLSNLFADYKVSDSLYRRAKVSDEKR

IQARGLQLKSSPEEVLNQMQEGVRKRVSFWGLPDYYRPLTGGEKALQVGMGALTLPLFIGFGLFLYSLDVNGYLYLPL

PILGFLGLVLSVFYYWKLRLDNRDGVLNBAGAEVYYLWTSFENMLRIARLDQAELESVVWNRLLVYATLFGYADK

VSHLMKVNQIQVENPDINLYVAYGWHSTYHSTAQMSHYASVANTASTYSVSSGSGSSGGGFSGGGGGGSIGAFZ (SEQ ID. NO. 126)
MKKVRKIFQKAVAGLCCISQLTASSIVALAETPETSPAIGKVVIKBTOEGGALLGDAVFELKNNTDGTTVSQRTEAQTG

EAIFSNIKPGTYTLTEAQPPVGYKPSTKQWTVEVEKNGRTTVQGEQVENREEALSDQYPQTGTYPDVQTPYQUCVDGS

EKNGQHKALNPNPYERVPEGTLSKRIYQVNNLDDNQYGIELTVSGKTVYEQKDKSVPLDVVILLDNSNSMSNIRNKNA

RRAERAGEATRSLIDKTSDSENRVALVTYASTIFDGTEFTVBKGVADKNGKRLNDSLFwNYDQTSVITNTKDYSYLKL

TNDKNDIVELKNKVPTEAEDHDGNRLMYQFGATFTQKALMKADEILTQQARQNSQKVIFHITDGVPTMSYPINFNHAT

FAPSYQNQLNAFFSKSPNKDGLLSDRTQATSGEITIVRGDGQSYQMFTDKTVYEKGAPAAFPVKPEKYSEMKAAGYA

VGDPNGGYWLNWRESILAYPFNSNTAKITNHGDPTRWYYNGNIAPDGYDVFTVGIGINGDPGTDEATATSFMQSISS

KPENYTNVTDTRKILEQLNRYFHTIVTEKKSENGTITDPMGELIDLQLGTDGRFDPADYTLTANDGSRLENGQAVGGP

QNDGGLLKNAKVLYDRREKRIRVTGLYLGTDEKVTLTYNVRLNDEFVSNKFYDTNGIfLRLHPKEVEQNTVRDFPIPKI

RDVRKYPEITSKEKKLGDIBFIKVNKNDKKPLRGAVFSLQKQHPDYPDIYGAIDQNGTYQNVRTGEDGKLTFKNLSDG

KYRLFENSEPAGYKPVQNKPIVAFQIVNGEVRDVTSVPQDIPAGYEFTNDKHYRRNEPIPPKREYPRTGGIGMLPFYLIG

CMMMGGVLLYRRKHPZ (SEQ ID. NO. 127)
MKSINKFLTMLAALLLTASSLFSAATVFAAGTTTTSVTVHKLLATDGDMDKIANELETGNYAGNKVGVLPANAKEIAG

TLTGSKAVPIEIELPLNDVVDAHVYPKNTEAKPKIDKDFKGKANPDTPRVDKDTPVNHQVGDVVEYEIVTKIPALANYA

TANWSDRMTEGLAFNKGTVVTVDDVALEAGDYALTEVATGFDLKLTDAGLAKVNDQNAEKTVKITYSATLNDKAI

VEVPESNDVTINYGNNPDHGNTPKPNKPNENGDLTLTKTWVDATGAPIPAGAEATFDLVNAQTGKVVQTVTLDKN

TVTVNGLDKNTEYKFVERSIKGYSADYQEITTAGEIAVKNWKDENPKPLDTEPKVVTYGKKFVKVNDKDNRIAGAEF

EWVADKDNENVVKLVSDAQGRFEITGLLAGTYYLEETKQPAGYALLTSRQKFEVTATSYSATGQGIEYTAGSGKDDAT

KVVNKKITIPQTGGIGTIIFAVAGAAIMGIAVYAYVKNNKDEDQLAZ (SEQ ID. NO. 128)
MTMQKMQKMSRJFFVMALCPSLVWGAHAVQAQEDHTLVLQLENYQEVVSQLPSRDGHRLQVWKLDDSYSYDDRV

QIVRDLHSWDENKLSSFKKTSFEMTFLENQIEVSHIPNGLYYVRSUQTDAVSYPAEPLFEMTDQTVEPLVIVAKJCTDTM

VKLIKVDQDHNRLEGVGFKLVSVARDVSEKEVPLIGEYRYSSSGQVGRTLYTDKGEIPVRNLPLGNYRYKEVEL

TABLE 2-continued

AGYAVTTLDTDVQLVDHQLVTITVVNQKLPRGNVDFMKVDORTNTSLQGAMFKVMKEESGHYTPVLQNGKEVVVTS
GKDGRFRVEGLEYGTYYLWELQAPTGYVQLTSPVSFTIGKDTRKELVTVVKNNKRRJDVPDTGEETLVYLDACCHV
VWZ (SEQ ID. NO. 129)
MSHIYLSIFTSLLLMLGLVNVAQADEYLRIGMEAAYAPFNWTQDDDSNGAVKIDGTNQYANGYDVQIAKKAKDLGKE
PLVVKTKWEGLVPALTSGKIDMIIAGMSAERICQEIAFSSSYYTSEPVLLVKKDSAYAS&YLDDPNGAKITSQQGVYL
YNLL4QIPGAKICITAMGDFAQMRQALEAGVDAYVSERPEALTAEAANSKFKMIQVEPGFKGEEDTAIAIGLRKNDNR
ISQINASIETSKDDQVALMDRMIKEQPAEATITEETSSSFFSQVAKILSENWQQLLRGAGITLLISVGTIIGLIIGLAIGVFR
TAPLSENKVIYGLQKLVGWVLNVYIEIRGTPMVQSMVIYYGTAQAFGINLDRTLAAIFIVSINTGAYMTEVRGGILAV
DKGQFEAATALGMTHNQTMRKWLPQVVRNILPATGNEFVINIKDTSVLNVISVVELYFSGNTVATQTYQYFQTFRIIAV
IYFVLTFTVTRILRFIERRMDMDTYTROANQMQTEDLKZ (SEQ ID. NO. 130)
MTQAILEIKHLKKSYGQNEVLKDSLTHKGEVISIIGSSGSGKSTFLRINLLETPTDGQYHGQNVLEKGYDLTQYREK
LGMVFQSFNLFENLNVLENTIVAQTRVLKRERTEAEKIAKENLEKVGMGERYWQAKPKQLSGGQKQRVALARALSMN
PDAILFDETSALDPEMVGEVLKIMQDLAQEGLTMIVVTHEMEFARDVSHRVFMDKGVLAEEGKPEDLFTNPKEDRTK
EFLQRYLKZ (SEQ ID. NO. 131)
MKKYQLLFSAVFSYLFFVFSLSQLTLIVQNYWQFSSQGNLPWIQNILSLLFIGVMIVVLVQGHGYLFPJPPJCKWLW
YSLTVLVLVQISFNVQTAKHVQSTAEGWAVLIGYSGTNFAELGIYALFFLVPLMEELYRGLLQHAFFKRFGLDLL
LPSILFALPHFSSLPSLLDIFVFATVGIIFAGLTRYTKSIYPSYAVHVINNIVATFPFLLTFLHRVLGZ (SEQ ID. NO. 132)
MNKKQWLGLGLVAVAAVGLAACGNRSSRNAASSSDVKTKIVTDTGGVDDKSFNQSAWEGLQAWGKEHNKDN
GFTYFQSTSEADYANNLQQAAGSYNLIFGVGFALNNAVKDAAKEHTDLNYYLIDDVIKDQKNVASVTFADNESGYLA
GVAAAKTTKTKQVGFVGGIESEVISRFEAGFKAGVASVDPISKVQVDYAGSFGDAAKGKTIAAQYAAGADIVYQVAG
GTGAGVFAEAKSLNESRPENEKVWIGVDRDQEAEGKYTSKDGKESNFVLVSTLKQVGTTVKDISNKAERGEFPGGQV
IVYSLKDKGVDLAVTNLEEGKKAVEDAKAKILDGSVKPEKZ (SEQ ID. NO. 133)
MSKKLQQISVPLISVFLGILLGAIVMWIFGYDAIWGYEELPYTAFGSLRGIGEIFRAMGPLVLIGLGFAVASRAGFPNVGL
PGQALAGWILSGWFALSHPDMPRPLMILATIVIALIAGGIVGAIPGILRAYLGTS2VIVTIMMNYIVLYVGNAPIHAPPKD
FMQSTDSTIRVGANATYQTPWLAELTGNSRMNIGIFFAIIAVAVIWFMLKKTRLGFEIRAVGLNPMASEYAGISAKRTHL
SMIISGALAGLGGAVEGLGTFQNVYVQGSSLAIGFNGMAVSLLAANSPIGILPAAFLFGVLQVGAPGMNAAQVPSELVSI
VTASIIFFVSVEYLIERPVKPKKQVKGGKZ (SEQ ID. NO. 134)
MGVKKLKLTSLLGSLLITACATNGVTSDITAESADWSKLVYFFAEIIRFLSFDISIGVGuLFRVLIRTVLLPVQVQ
MVASRKMQEAQPRIKALREQYPGRDMESRTKLEQEMRKVFKEMGVRQSDSLWPILIQMPVILALFQALSRVDFLKTGH
FLWINLGSVDTRLVLPILAAVFTFLSTWLSNKALSERNGATTAMMYGIPVLIRPAVYAPGGVALYWTVSNAYQVLQTY
FLNNPFKIIAEREAVVQAQKDLENRKRKAKKKAQKTKZ (SEQ ID. NO. 135)
MVIDPFANELDYYLVSHFHSDHIDPYTAAAILNNPKLEHVKFIGPYHCGRIWEGWGVKERFLVVKPGDTIELKDMKIH
AVESFDRTCLVTLPVNGADETGGELAGLAVTDEEMAQKAVNYIPETPGGTIYHGADSHFSNYFAJCHGKDFKIDVALNN
YGENPVGIQDKMTSIDLLRMAENLRTKVIIPVHYDIWSNFMASTNEILELwKMRKDRLQYDFHPFIwEVGGKYTYPQD
QHLVEYHHPRGFDDCFEQDSNIQFKALLZ

TABLE 2-continued (SEQ ID. NO. 136)
MFLSGWLSFANYIHDLLVLFPDSPFLNAFESAIAAPLVEELSCVFVTM4PVRXKSTLTGIASOLCFQMIKN
GYIRTDLPEGFDFTISRILERJISGIASHWTFSGLAVVGVYLLYRAYKC3QKVGKKQGLIFLGLALGTHFLFNSPFVELETEI
PLAIPVVTAIALYGFYMAYCFVEKHNELMTZ (SEQ ID. NO. 137)
MKVEPRCDVLSRMSHFFIRILIMLQELVERSWAIRQAYHELEVKHHDSKVRRVEEDLLALSNDIGNPQRLVMTKQGRY
YDETPYTLEQKLSENIWWLLELSQRLDIDILTEMENFLSDKEKQLNVRTWKZ (SEQ ID. NO. 138)
MLDWKQFFLAYLRSRSRLFIYLLSLAFLVLLFQFLASLGIYFLYFPPLCCFVTILFRWDILVETQVYRQELLYGEREAK
SPLEIALAEKLEAREMELYQQRSKAERKLTDLLDYYTLWVHQIKTPIAASQLLVAEVVDRQLKQQLEQEIFICIDSYTNLV
LQYLRLESPHDDLVLKQVQIEDLVKEIIRKYALFRQKGLNVNLHDLDKEIVTDKJCwLLVVIEQIISNSLKYTKEGGLEIY
MDDQELCIKDTGIGIKNSDVLRVFERGFSGYNGRLTQQSSGLGLYLSKKISEELGHQIRIESEVGKGTRVRIQFAQVNLVL
EZ (SEQ ID. NO. 139)
MELNTHNAEILLSAANKSHYPQDELPEIALAGRSNVGKSSFINTMLNRXNLARTSGKPGQLLNFFNIDDKMRFVDVP
GYGYARVSKKEREKWGCMIEEYLTRRENLAVVSLVDLRHDPSADDVQMYEFLKYYEIPVIRVATKADKIPRGKWNKH
ESAIKKKLNFDPSDDFILFSSVSKAGMDEAWDAILEKLZ (SEQ ID. NO. 140)
MTKKQLHLVVTGMSGAGKTVAIQSFBDLGYFEDNMPPALLPKFLQLVEIKEDNPKLALVVDMRSRSFFSEIQAVLDEL
ENQDGLDPKILLDAADKELVARYKETRRSHPLAADGRLDGIgLRELLAPLKNMSQNVVDRRELTPRELRITLAEQF
SDQEQAQSFPJEVMSFGIKYGIPIDADLVFDVRFLPNPYYLPELRNQTGVDEPVYDYVMNHPESEDFYQHLLALIEPILP
SYQKEGKSVLTIAMGCTGGQMRSVAFAKRLAQDLSKNWSVNEGHPDKDRRKETVNRSZ (SEQ ID. NO. 141)
MRKPKITVIGGGTGSPVTLKSLREKDVEAAIVTVADDGGSSGELRKNMQQLTPPGDLRNVLVAMSDMPKFYEKVFQYR
FSEDAGAFAGHPLGNLUAGLEMQGSTYNAMQLLSKFPHRGKYPSSDHPLTLVFQTEVAGHIVDMRGIIDN
EVLHRLRPFIDTVLVNEKVPEYMNSNRPDEYLVQVEHDFVGLCKQVSRVISSNPLPENGGAIDLIVDELMR
IQVKKZ (SEQ ID. NO. 142)
MKNLIKLLIUVNLADSVFYIVALWHVSNNYSSSMFLGFIAVNYLPDLLLIGPVDRVNPQKILIILVQLAVAVIFT
LLLNQISFWVIMSLVFSVMASSISYVIEDVLIQVVEYDKIVFANSLFSISYKVLDSFNSFFLQVAVGILLVKIDIGIPL
LALFILLLLKRTSNANIENFSFKYYKREVLQGTHFILNNGLLFTSISLTLINFFYSFQTVVVPFSIRYGPIJYGIPLT
GLGGILGNMLAPIVIKYLKSNQVGVFLFLNGSSWLVAIVIKDYTLSLILFFVCFMSKGVNIINSLYQQIPPHQLLGRVN
TTIDSIISFGMPIGSLVAGTLIDLNIELVLIAISIPYFLFSYLFYTDNGLKEFSIYZ (SEQ ID. NO. 143)
MMSNKNKEILIFAILYTVLFMFDGVKLLASLMPSAIANYLVYVVLALYGSFLFKDRLIQQWKEIRKTKRKFFFGVLTGW
LFLILMTVVFEFVSEMLKQFVGLDGQGLNQSNIQSTFQEQPLLIAVFACVIGPLVEELFFRQVLLHYLQERLSGLLSIILV
GLVFALTHMHSLALSEWIGAVGYLGGGLAFSIIYVKEKENIYYPLLVHMLSNSLSLIILAISIVKZ (SEQ ID. NO. 144)
LKKPIIEFKNVSKVFEDSNTCVLKDNFELEEGICYTLLGASGSGKSTILNHAGLLDATRGDIMLDGVRINDPTIKRDVH
TVFQSYALFPHMNVFENVAFPLRLRKIDKKEIEQRVAEVLKMVQLEGYEKRSLRKLSGGQRQRVAIARAIINQPRVVLLD
EPLSALDLKLRTDMQYELRELQQRLGITFVFVTHDQEALAMSDWTVMNDGETVQSGTPVDIYDEPINHFVATFGBSN
ILPGTMIEDYLVEFNGKREAVDGGMKPNEPVEVVIRPEDLRTLPEEGKLQVKVDTQLFRGVHYEUAYDELGNEWMI
HSTRKAVGEEGLDFBPEDIHIMRLNETEEEFDAPJEEYVEIEEQEAGLINAIEEERDEENKLZ TABLE 2-continued (SEQ ID. NO. 145)
MKSMRILFLLALIQISLSSCFLWKECILSFKQSTAFFIGSMVFVSGICAGVNYLYTRKQEVHSVLASKKSVKLFYSMLLLN

LLGAVLVLSDNLFKNLQQELVDFLLPSFFLFGLDLLIFLPLKXYVRDFLAMLDRXTVLVTILATLLFLRNPMTVSL

LIYIGLGLFFAAYLVPNSVKKEVSFYGHIRDLVLVIVTLIFFZ (SEQ ID. NO. 146)
MVKKIIGMVLALLSVTVVGVGVFAYTIYQQGTETLAIZTYKKIGEETKVIEATEPLTILLMGVURGNVERTETWVGRSDS

MILMTVNPKTKRITMMSLERDILTRIESGNGQAHEAKLNSAYADGGAELAIETIQKMMNIHIDRYVMVNMRGLQKLV

DAVGGRRVNNLGFPISSDQEENTSIGVGEQHIGGEEALVYARMRYQDPEGDYGRQKRQREVIQKVMEKALSLNSIGH

YQEILKALSDNMQTNIDLSAKSPNLLGYPZDSFKTIETQQLQGEGEILQGVSYQIVSRAHMLEMQNLLRRSLGQEEVTQL

ETNAVLFEDLFGRAPVGDEDNZ (SEQ ID. NO. 147)
MKKQAYVUALTSFLFVFFFSHSLLEILDFDWSIFLHDVEKTEKFVFLLLVFSMSMTCLLALFwRGIEELSLRKMQANLK

RLLAGQEVVQVADPDLDASFKSLSGKLNLLTEALQKAENQSLAQEEEIIEKERKRIARDLHDTVSQELFAAHMILSGISQ

QALKLDREKMQTQLQSVTAILETAQKDLRVLLLHLRPVELEQKSLIEGIQILLKELEDKSDLRVSLKQNMTKLPKKLEEHI

FRJLQELSNTLRHAQASCLDVYLYQTDVELQLKVVDR4GIGFQLGSLDDLSYGLRNIKERVEDMAGTVQLLTAPKQGLA

VDIRIPLLDKEZ (SEQ ID. NO. 148)
MIVSIISQGFVWAILGLGIFMTFRILNFPDMTTEGSIPLGGAVAVTLITKGVNPFLATLVAVGAGCLAGMAAGLLYTKGK

IPTLLSGILVMTSCHSIMLLIMGRANLGLLGTKQIQDVLPFDSDLNQLLTGLRFVSRVXALMLPLLDTKLGQAYIATGDNP

DMARSFGHTGRMELMGLVLSNGVIALAOALAQQEGYADVSRGGVIVVGLASLIIGEVISLAEPVTIVVGSIAY

QFLVWAVIAIOFNTSYLRLYSALILAVCLMUTFKQTILKGAJCLSKZ (SEQ ID. NO. 149)
MKKMKVWSTVLATGVALTRLAACSGGSNSTTASSSEEKADKSQELVIYSNSVSNGRGDWLTAXAEAGFNIKMVDIAG

AQLADRVLAEKNNAVADMVFGIGAVDSNKIRDQKLLVQYKPKWLDKIDQSLSDKDNYYNPVIVQPLVLIGAPDVKEMP

KDWTELGSKYKGKYSISGLQGGTGRALASILVRYLDDKGELGVSEKGWEVAICEYLKNAYTLQKOESSIVKMLDKEDPI

QYGMMWGSGALVGQKEQNVVPKVMTPEIGVPFVTEQTMVLSTSKKQALAKEFIDWFGQSEIQVEYSKNFGSIPANKD

ALKDLPEDTKKFVDQVKPQNIDWEAVGKHLDEWVEKAELEYVQZ (SEQ ID. NO. 150)
MIKFDNIQIKYGDFVAIDNLNLDHEGEFTFLGPSGCGKSTLRALVGFLDPSSGSIEVNGTDVTHLEPEKRGIGVFQSY

ALFPTMTVDNIAFGLKVKKVAPDVIKAKVSAVAAKIKISDQQLQRNVSELSGGQQQRVALARLVLEPKILCLDEPLS

NLDAKLRVDLRKELKRLQKELGRITLYVTHDQEEALTLSDRIAVFNNGYIEQVGTPVEIYHNSQTEVCDPIGDNVLTD

ETVHEVLLKNTSVFLEDKKGYIRLEKVRFNRETEQDFLKGTUDVEFSGVTEHYTIKVSESQILNVTSIDSQAARSVGESV

ELFITPSDVLQFZ (SEQ ID. NO. 151)
MRHKLNLKDWLRLGLRWFLVTRIYPNFDLVVNVFVKGGESLDAVHRVLKQPALQSMNSPSLIVNVVGIL

CVLFTEYFDIKGAKZLKLGYMTSLIYGGVVLATGYKFVYGPYGLITKFLQNVIPSLDPNWPIGYGAVLFIMTFSGTANHT

LFLTNTHSVDYTIEARNMGKPVFRICVVLPTLITLFALTIMVFLSGLSAVAAPMIVGGKEFQTINPMIITFAGMG

NSRDLAALLAIILGIATTILLTIMNKIEKGGNYISISKTKAPLKKQKIASKPWNIIAHIVAYGLFTVFMLPLIFIVLYSPTDPV

VIALNFNSLLTDFDLSVFLYHPLAQPLGITIPSAGDETATSNAQALVF®YTIVLMIISGTVLYPTQPJGPJVPJCZ

TABLE 3

ID201 - 4106.4 (SEQ. ID. NO. 168)
ATGATAAAAAATCCTAAATTATTAACCAAGTCTTTTTTAAGAAGTTTTGCAATTCTAGGTGGTTGGTCTAGTCAT

TCATATAGCTATTTATTTGACCTTTCCTTTTTATTATATTCAACTGGAGGGGAAAAGTTTAATGAGAGCGCAAGAG

TGTTTACGGAGTATTTAAAGACTAAGACATCTGATGAAATTCCAAGCTTACTCCAGTCTTATTCAAAGTCCTTGACC

ATATCTGCTCACCTTAAAAGAGATATTGTAGATAAGCGGCTCCCTCTTGTGCATGACTTGGATATTAAAGATGGAAA

GCTATCAAATTATATCGTGATGTTAGATATGTCTGTTAGTACAGCAGATGGTAAACAOGTAACCGTGCAATTTGTTC

ACGGGGTGGATGTCTACAAAGAAGCAAAGAATATTTTGCTTTTGTATCTCCCATATACATTTTTGGTTACAATTGCT

TTTTCCTTTGTTTTTCTTATTTTTATACTAAACGCTTGCTCAATCCTCTTTTTTACATTTCAGAAGTGACTAGTAA

AATGCAAGATTTGGATGACAATATTCGTTTTGATGAAAGTAGGAAAGATGAAGTTGGTGAAGTTGGAAAACAGATTA

ATGGTATGTATGAGCACTTGTTGAAGGTTATTTATGAGTTGGAAAGTCGTAATGAGCAAATTGTAAAATTGCAAAAT

CAAAAGGTTTCCTTTGTCCGCGGAGCATCACATGAGTTGAAAACCCCTTTAGCCAGTCTTAGAATTATCCTAGAGAA

TATGCAGCATAATATTGGAGATTACAAAGATCATCCAAAATATATTGCAAAGAGTATAAATAAGATTGACCAGATGA

GCCACTTATTAGAAGAAGTACTGGAGTCTTCTAAATTCCAAGAGTGGACAGAGTGTCGTGAGACCTTGACTGTTAAG

CCAGTTTTAGTAGATATTTTATCACGTTATCAAGAATTAGCTCATTCAATAGGTGTTACAATTGAAAATCAATTGAC

AGATGCTACCAGGGTCGTCATGAGTCTTAGGGCATTGGATAAGGTTTTGACAAACCTGATTAGTAATGCAATTAAAT

ATTCAGATAAAAATGGGCGTGTAATCATATCCCAGCAAGATGGCTATCTCTCTATCAAAAATACATGTGCGCCTCTA

AGTGACCAAGAACTAGAACATTTATTTGATATATTCTATCATTCTCAAATCGTGACAGATAAGGATGAAAGTTCCGG

TTTGGGTCTTTACATTGTGAATAATATTTTAGAAAGCTATCAAATGGATTATAGTTTTCTCCCTTATGAACACGGTA

TCGAATTTAAGATTACCTTATAG (SEQ. ID. NO. 152)
MIKNPKLLTKSFLRSFAILGGVGLVIHIAIYLTFPFYYIQLEGEKFNESARVFTEYLKTKTSDEIPSLLQSYSKSLT

ISAHLKRDIVDKRLPLVHDLDIKDGKLSNYIVMLDMSVSTADGKQVTVQFVHGVDVYKEAKNILLLYLPYTFLVTIA

FSFVFSYFYTKRLLNPLFYISEVTSKMQDLDDNIRFDESRKDEVGEVGKQINGMYEHLLKVIYELESRNEQIVKLQN

QKVSFVRGASHELKTPLASLRIILENMQHNIGDYKDHPKYIAKSINKIDQMSHLLEEVLESSKFQEWTECRETLTVK

PVLVDILSRYQELAHSTGVTTENGLTDATRVVMSLRALDKVLTNLTSNATTCYSDJGRVIISEQDGYLSIKNTCAPL

SDQELEHLFDIFYHSQIVTDKDESSGLGLYIVNNILESYQMDYSFLPYEHGMEFKISLZ

ID202 - 41069 (SEQ. ID. NO. 169)
ATGGATAAAATTATTAAAACTATATCAGAAAGCGGAGCCTTTCGTGCTTTTGTCCTTGATAGCACTGAAACCGTCCG

CACTGCTCAAGAAAAACATCAAACCCAAGCTAGCTCAACTGTAGCGCTTGGTCGAACTCTTATCGCTAGCCAGATTC

TCGCAGCCAATGAAAAGGAAATACCAAACTTACAGTTAAGGTGTTGGGATCTAGCTCTCTAGGTGCTATTATCACC

GTCGCTGATACCAAGGGGAACGTCAAAGGCTATGTTCAAAATCCTGGTGTTGACATCAAAAAGACTGCGACTGGTGA

AGTCCTAGTCGGACCTTTTGTTGGAAATGGTCAATTCCTCGTTATCACAGACTACGGTACTGGAAATCCTTACAACT

CTATAACTCCCCTCATCTCTGGAGAAATCGGTGAAGACCTTGCCTTTTACCTTACTGAAAGCCAACAAACGCCTTCA

GCGGTCGGCCTCAATGTCCTTTTGGACGAGGAAGACAAGGTCAAGGTTGCAGGTGGTTTCCTAGTTCAAGTCTTGCC

AGGAGCCAAGAAAGAAGAGATTGCTCGCTTTGAAAAACGCATCCAAGAAATGCCAGCTATCTCTACTCTTCTCGAAA

CGTTTCCAATGTGACTGTAGCCATGAACGCTTTATGAACGCTCTTGCCAGCCTTCCAAGCTCAGACTTACAGGAAAT

GAAAGAGGAAGACCACGGGCAGAAATCACTTGTCAATTCTGCCAAACTACTTACAACTTTGATGAAAAGGACCTGG

AGGAACTCATTCGTGACAAATCTTAA (SEQ. ID. NO. 153)
MDKIIKTISESGAFRAFVLDSTETVRTAQEKHQTQASSTVALGRTLIASQILAANEKGNTKLTVKVLGSSSLGAIIT

VADTKCNVICGYVQPCVDTKKTATGEVLVGPFVGNGQFLVTTDYGTG&PYNSTTPLTSGETGEDLAFYLTESQQTPS

TABLE 3-continued

AVGLNLLDEEDKVKVAGGFLVQVLPGAKKEETARFETCRTQEMPATSTLLESDDHIEALLKATYGDEAYKRLSEEEI

RFQCDCSHERFMNALASLPSSDLQEMKEEDHGAEITCQFCQTTYNFDEKDLEELIRDKSZ

ID203 - 4115                                                    (SEQ. ID. NO. 170)
ATGAAATCAATAACTAAAAAGATTAAAGCAACTCTTGCAGGAGTAGCTGCCTTGTTTGCAGTATTTGCTCCATCATT

TGTATCTGCTCAAGAATCATCAACTTACACTGTTAAAGAAGGTGATACACTTTCAGAAATCGCTGAAACTCACAACA

CAACAGTTGAAAAATTGGCAGAAAACAACCACATTGATAACATTCATTTGATTTATGTTGATCAAGAGTTGGTTATC

GATGGCCCTGTAGCGCCTGTTGCAACACCAGCGCCAGCTACTTATGCGGCACCAGCCGCTCAAGATGAAACTGTTTC

AGCTCCAGTAGCAGAAACTCCAGTAGTAAGTGAAACAGTTGTTTCAACTGTAAGCGGATCTGAAGCAGAAGCCAAAG

AATGGATCGCTCAAAAAGAATCAGGTGGTAGTATACAGCTACAAATGGACGTTATATCGGACGTTACCAATTAA (SEQ. ID. NO. 154)
MKSITKKIKATLAGVAALFAVFAPSFVSAQESSTYTVKEGDTLSEIAETHNTTVEKLAENNHTDNTHLTYVDQELVI

DGPVAPVATPAPATYAAPAAQDETVSAPVAETPVVSETVVSTVSGSEAEAKEWIAQKESGGSIQLQMDVISDVTNZ

ID204 - 4111.7                                                  (SEQ. ID. NO. 171)
ATGAATTTAGGAGAATTTTGGTACAATAAAATAAATAAGAACAGAGGAAGAAGGTTAATGAAGAAAGTAAGATTTAT

TTTTTTAGCTCTGCTATTTTTCTTAGCTAATCCAGAGGGTGCAATGGCTAGTGATGGTACTTGGCAAGGAAAACAGT

ATCTGAAAGAAGATGGCAGTCAAGCAGCAAATGAGTGGGTTTTTGATACTCATTATCAATCTTGGTTCTATATAAAA

GCAGATGCTAACTATGCTGAAAATGAATGGCTAAAGCAAGGTGACGACTATTTTTACCTCAAATCTGGTGGCTATAT

GGCCAAATCAGAATGGGTAGAAGACAAGGGAGCCTTTTATTATCTTGACCAAGATGGAAAGATGAAAAGAAATGCTT

GGGTAGGAACTTCCTATGTTGGTGCAACAGGTGCCAAAGTAATAGAAGACTGGGTCTATGATTCTCAATACGATGCT

TGGTTTTATATCAAAGCAGATGGACAGCACGCAGAGAAGAATGGCTCCAAATTAAAGGGAAGGACTATTATTTCAA

ATCCGGTGGTTATCTACTGACAAGTCAGTGGATTAATCAAGCTTATGTGAATGCTAGTGGTGCCAAAGTACAGCAAG

GTTGGCTTTTTGACAAACAATACCAATCTTGGTTTTACATCAAAGAAAATGGAAACTATGCTGATAAAGAATGGATT

TTCGAGAATGGTCACTATTATTATCTAAAATCCGGTGGCTACATGGCAGCCAATGAATGGATTTGGGATAAGGAATC

TTGGTTTTATCTCAAATTTGATGGGAAAATGGCTGAAAAAGAATGGGTCTACGATTCTCATAGTCAAGCTTGGTACT

ACTTCAAATCCGGTGGTTACATGACAGCCAATGAATGGATTTGGGATAAGGAATCTTGGTTTTATCTCAAATCTGAT

GGGAAAATAGCTGAAAAAGAATGGGTCTACGATTCTCATAGTCAAGCTTGGTACTACTTCAAATCCGGTGGTTACAT

GACAGCCAATGAATGGATTTGGGATAAGGAATCTTGGTTTTACCTCAAATCTGATGGGAAAATAGCTGAAAAAGAAT

GGGTCTACGATTCTCATAGTCAAGCTTGGTACTACTTCAAATCTGGTGGCTACATGGCAAAAATGAGACAGTAGAT

GGTTATCAGCTTGGAAGCGATGGTAAATGGCTTGGAGGAAAAACTACAAATGAAATGCTGCTTACTATCAAGTAGT

GCCTGTTACAGCCAATGTTTATGATTCAGATGGTGAAAAGCTTTCCTATATATCGCAAGGTAGTGTCGTATGGCTAG

ATAAGGATAGAAAAAGTGATGACAAGCGCTTGGCTATTACTATTTCTGGTTTGTCAGGCTATATGAAAACAGAAGAT

TTACAAGCGCTAGATGCTAGTAAGGACTTTATCCCTTATTATGAGAGTGATGGCCACCGTTTTTATCACTATGTGGC

TCAGAATGCTAGTATCCCAGTAGCTTCTCATCTTTCTGATATGGAAGTAGGCAAGAAATATTATTCGGCAGATGGCC

TGCATTTTGATGGTTTTAAGCZTGAGAATCCCTTCCTTTTCAAAGATTTAACAGAGGCTACAAACTACAGTGCTGAA

GAATTGGATAAGGTATTTAGTTTGCTAAACATTAACAATAGCCTTTTGGAGAACAAGGGCGCTACTTTTAAGGAAGC

CGAAGAACATTACCATATCAATGCTCTTTATCTCCTTGCCCATAGTGCCCTAGAAAGTAACTGGGGAAGAAGTAAAA

TTGCCAAAGATAAGAATAATTTCTTTGGCATTACAGCCTATGATACGACCCCTTACCTTTCTGCTAAGACATTTGAT

GATGTGGATAAGGGAATTTTAGGTGCAACCAAGTGGATTAAGGAAAATTATATCGATAGGGGAAGAACTTTCCTTGG

AAACAAGGCTTCTGGTATGAATGTGGAATATGCTTCAGACCCTTATTGGGGCGAAAAAATTGCTAGTGTGATGATGA

AAATCAATGAAAGCTAGGTGGCAAAGATTAG

TABLE 3-continued (SEQ. ID. NO. 155)
MNLGEFWYNKINKNRGRRLMKKVRFIFLALLFFLASPEGAMASDGTWQGKQYLKEDGSQAANEWVFDTHYQSWFYIK

ADANYAENEWLKQGDDYFYLKSGGYMAKSEWVEDKGAFYYLDQDGKMKRNAWVGTSYVGATGAKVIEDWVYDSQYDA

WFYIKADGQHAEKEWLQIKGKDYYFKSGGYLLTSQWINQAYVNASGAKVQQGWLFDKQYQSWFYTKENGNYADKEWI

FENGHYYYLKSGGYMAANEWIWDKESWFYLKFDGKMAEKEWVYDSHSQAWYYFKSGGYMTANEWTWDKESWFYLKSD

GKIAEKEWVYDSHSQAWYYFKSGGYMTANEWIWDKESWFYLKSDGKIAEKEWVYDSHSQAWYYFKSGGYMAKNETVD

GYQLGSDGKWLGGKTTNENAAYYQVVPVTANVYDSDGEKLSYISQGSVVWLDKDRKSDDKRLAITISGLSGYMKTED

LQALDASKDFIPYYESDGHRFYHYVAQNASIPVASHLSDMEVGKKYYSADGLHFDGFKLENPFLFKDLTEATNYSAE

ELDKVFSLLNINNSLLENKGATFKEAEEHYHINALYLLAHSALESNWGRSKIAKDKNNFFGITAYDTTPYLSAKTFD

DVDKGILGATKWIKENYIDRGRTFLGNKASGMNVEYASDPYWGEKIASVMMKINEKLGGKDZ

ID205 - 41181.1 (SEQ. ID. NO. 172)
ATGAAAAAATTAGGTACATTACTCGTTCTCTTTCTTTCTGCAATCATTCTTGTAGCATGTGCTAGCGGAAAAAAGA

TACAACTTCTGGTCAAAAACTAAAAGTTGTTGCTACAAACTCAATCATCGCTGATATTACTAAAAATATTGCTGGTG

CAAAATTGACCTTCATAGTATCGTTCCGATTGGGCAAGACCCACACGAATACGAACCACTTCCTGAAGACGTTAAGA

AAACTTCTGAGGCTAAATTTGATTTTCTATAACGGTATCAACCTTGAAACAGGTGGCAATGCTTGGTTTACAAAATT

GGTAGAAAATGCCAAGAAAACTGAAAACAAAGACTACTTCGCAGTCAGCGACGGCGTTGATGTTATCTACCTTGAAG

GTCAAAATGAAAAGGAAAAGAAGACCCACACGCTTGGCTTAACCTTGAAAACGGTATTATTTTTGCTAAAAATATC

GCCAAACAATTGAGCGCCAAAGACCCTAACAATAAAGAATTCTCATGAAAAAAATCTCAAAGAATATACTGATAAGT

TAGACAAACTTGATAAAGAAAGTAAGGATAAATTTAATAAGATCCCTGCTGAAAAGAAACTCCATTGTAACCAGCGA

AAGGAGCATTCAAATACTTCTCTAAAGCCTATGGTGTCCCAAGTGCTTTACATCTGGGAAATCAATACTGAAGAAGA

AGGAACTCCTGAACAAATCAAGACCTTGGTTGAAAAACTTCGCCAAACAAAACTTCCATCACTCTTTGTAGAATCAA

GTGTGGATGACCGTCCAATGAAAACTGTTTCTCAAGACACAAACATCCCAATCTACGCTCAAATCTTTACTGACTCT

ATCGCAGAACAAGGTCCCGAAGGCGACAGCTACTACAGCATGATGAAATACAACCTTGACAAGATTGCTGAAGGATT

GGCAAAATAA (SEQ. ID. NO. 156)
MKKLGTLLVLFLSAIILVACASGKKDTTSGQKLKVVATNSIIADITKNIAGDKIDLHSIVPIGQDPHEYEPLPEDVK

KTSEANLIFYNGINLETGGNAWFTKLVENAKKTENKDYFAVSDGVDVIYLEGQNEKGKEDPHAWLNLENGIIFAKNI

AKQLSAKDPNNKEFYEKNLKEYTDKLDKLDKESKDKFNKIPAEKKLIVTSEGAFKYFSKAYGVPSAYIWEINTEEEG

TPEQIKTLVEKLRQTKVPSLFVESSVDDRPMKTVSQDTNIPIYAQIFTDSIAEQGKEGDSYYSMMKYNLDKIAEGLA

KZ

ID206 - 41191.1 (SEQ. ID. NO. 173)
ATGGAATGGTATAAAAAAATCGGACTTCTTGCAACTACAGGTTTAGCTTTGTTTGGGCTCGGCGCTTGCTCCAACTA

TGGTAAATCTGCGGATGGCACAGTGACCATCGAGTATTTCAACCAGAAAAAAGAAATGACCAAAACCTTGGAAGAAA

TCACTCGTGATTTTGAGAAGGAAAACCCTAAGATCAAGGTCAAAGTCGTCAATGTACCAAATGCTGGTGAAGTATTG

AAGACACGCGTTCTCGCAGGAGATGTGCCTGATGTGGTCAATATTTACCCACAGTCCATCGAACTGCAAGAATGGGC

AAAAGCAGGTGTTTTTGAAGATTGACCAACAAAGACTACCTGAAACGCGTGAAAATGGCTACGCTGAAAAATATGCT

GTAAACGAAAAAGTTTACAACGTTCCTTTTACAGCTAATGCTTATGGAATTTACTACAACAAAGATAAATTCGAAGA

ACTGGGCTTGAAGGTTCCTGAAACCTGGGATGAATTTGAACAGTTAGTCAAAGATATCGTTGCTAAAGGACAAACAC

CATTTGGAATTGCAGGTGCAGATGCTTGGACACTCAATGGTTACAATCAATTAGCCTTTGCGACAGCAACAGGTGGA

GGAAAAGAAGCAAATCAATACCTTCGTTATTCTCAACCAAATGCCATTAAATTGTCGGATCCGATTATGAAAGATGA

TATCAAGGTCATGGACATCCTTCGCATCAATGGATCTAAGCAAAAGAACTGGGAAGGTGCTGGCTATACCGATGTTA

TABLE 3-continued

TCGGAGCCTTCGCACGTGGGGATGTCCTCATGACACCAATGGGTCTTGGGCGATCACAGCGATTAATGAACAAAAAC

CGAACTTTAAGATTGGGACCTTCATGATTCCAGGAAAAGAAAAAGGACAAAGCTTAACCGTTGGTGCGGGAGACTTG

GCATGGTCTATCTCAGCCACCACCAAACATCCAAAAGAAGCCAATGCCTTTGTGGAATATATGACCCGTCCAGAAGT

CATGCAAAAATACTACGATGTGGACGGATCTCCAACAGCGATCGAAGGGGTCAAACAAGCAGGAGAAGATTCACCGC

CTTGCTGGTATGACCGAATATGCCTTTACGGATCGTCACTTGGTCTGGTTGCAACAATACTGGACCAGTGAAGCAGA

CTTCCATACCTTGACCATGAACTATGTCTTGACCGGTGATAAACAAGGCATGGTCAATGATTTGAATGCCTTCTTTA

ACCCGATGAAAGCGGATGTGGATTAG (SEQ. ID. NO. 157)
MEWYKKIGLLATTGLALFGLGACSNYGKSADGTVTIEYFNQKKEMTKTLEEITRDFEKENPKIKVKVVNVPNAGEVL

KTRVLAGDVPDVVNIYPQSIELQEWAKAGVFEDLSNKDYLKRVKNGYAEKYAVNEKVYNVPFTANAYGIYYNKDKFE

ELGLKVPETWDEFEQLVKDIVAKGQTPFGIAGADAWTLNGYNQLAFATATGGGKEANQYLRYSQPNAIKLSDPIMKD

DIKVMDILRTNGSKQKNWEGAGYTDVIGAFARGDVLMTPNGSWAITAINEQKPNFKIGTFMIPGKEKGQSLTVGAGD

LAWSISATTKHPKEANAFVEYMTRPEVMQKYYDVDGSPTAIEGVKQAGEDSPLAGMTEYAFTDRHLVWLQOYWTSEA

DFHTLTMNYVLTGDKQGMVNDLNAFFNPMKADVDZ

ID207 - 4123.1                                                    (SEQ. ID. NO. 174)
ATGAAGAAAATCAAACCGCATGGACCGTTACCAAGTCAGACTCAGCTAGCTTATCTGGGAGATGAACTAGCAGCTTT

TATCCACTTCGGTCCTAATACCTTTTATGACCAAGAATGGGGGACTGGACAGGAGGATCCTGAGCGCTTTAACCCGA

GTCAGTTGGATGCGCGTGAGTGGGTTCGTGTGCTCAAGGAAACGGGCTTCAAAAAGTTGATTTTGGTGGTCAAGCAC

CACGATGGCTTTGTCCTTTATCCGACAGCTCACACAGATTATTCGGTTAAGGTCAGTCCTTGGAGGAGAGGAAAGGG

CGAGTTGCTCCTTGAAGTATCCCAAGCTGCCACAGAGTTTGATATGGATATGGGGGTCTACCTGTCACCGTGGGATG

CCCATAGTCCCCTCTATCATGTGGACCGAGAAGCGGACTACAATGCCTATTATCTGGCTCAGTTGAAGGAAATCTTA

TCAAATCCTAACTATGGGAATGCTGGTAAGTTCGCTGAGGTTTGGATGGATGGTGCCAGAGGAGAGGGCGCGCAAAA

GGTTAATTATGAATTTGAAAAATGGTTTGAAACCATTCGTGACCTGCAGGGCGATTGCTTGATTTTTTCAACAGAAG

GCACCAGTATCCGCTGGATTGGCAATGAACGAGGGTATGCAGGTGATCCACTGTGGCAAAAGGTGAATCCTGATAAA

CTAGGAACAGAAGCAGAGCTGAACTATCTTCAGCACGGGGATCCCTCGGGCACGATTTTTTCAATCGGAGAGGCAGA

TGTTTCCATCCGTCCAGGCTGGTTCTACCATGAGGATCAGGATCCTAAGTCTCTCGAGGAGTTGGTCGAAATCTACT

TTCACTCAGTAGGGCGAGGAACTCCACTCTTGCTTAATATTCCGCCGAATCAAGCTGGGCTCTTTGATGCAAAGGAT

ATTGAACGACTTTATGAATTTGCGACCTATCGCAATGAGCTCTATAAAGAAGATTTGGCTCTGGGAGCTGAGGTATC

TGGTCCAGCTCTTTCCGCAGACTTTGCTTGTCGCCATTTGACAGACGGCCTTGAGACCAGCTCTTGGGCAAGCGATG

CAGACTTGCCCATCCAGTTAGAACTCGACTTAGGTTCTCCTAAAACTTTTGATGTAATTGAGTTAAGAGAAGATTTG

AAGCTAG GGCCCGAATCGCTGCTTTTCATGTGCAAGTAGAGGTGGATGGTGTCTGGCAGGAGTTTGGTTCGGGTCA

TACTGTTGGTTACAAACGTCTCTTACGAGGAGCAGTTGTTGAGGCACAGAAGATACGTAGTCATTACAGAATCAC

AGGCCTTTGCCTTTGTTGACCAAGATTTCCCTTTATAAAACTCCTGGATTATCAAAAAAAGAAGTTGTTCAGGAACT

AGCATTTGCAGAAAAAAGCCTAGCTGTGGCAAAGGGAGAAAATGCCTATTTTACAGTTAAGCGCAGAGAATGTAGTG

GTCCTTTAGAAGCTAAGATTTCGATTCAACCGGGGACAGGTGTCCATGGTGTCGCCTATCAGGATGAGATTCAAGTC

CTTGCGTTTCAAACTGGTGAGACTGAAAAAAGTCTGACGCTACCAACCTTGTATTTCGCAGGAGATAAAACCTTGGA

TTTCTATCTGAACCTAACGGTGGATGGTCAGCTTGTGGATCAACTTCAAGTCCAAGTTTCATAA (SEQ. ID. NO. 158)
MKKIKPHGPLPSQTQLAYLGDELAAFIHFGPNTFYDQEWGTGQEDPERFNPSQLDAREWVRVLKETGFKKLILVVKH

HDGFVLYPTAHTDYSVKVSPWRRGKGDLLLEVSQAATEFDMDMGVYLSPWDAHSPLYHVDREADYNAYYLAQLKEIL

SNPNYGNAGKFAEVWMDGARGEGAQKVNYEFEKWFETIRDLQGDCLIFSTEGTSIRWIGNERGYAGDPLWQKVNPDK

TABLE 3-continued

LGTEAELNYLQHGDPSGTIFSIGEADVSIRPGWFYHEDQDPKSLEELVEIYFHSVGRGTPLLLNIPPNQAGLFDAKD

IERLYEFATYRNELYKEDLALGAEVSGPALSADFACRHLTDGLETSSWASDADLPIQLELDLGSPKTFDVIELREDL

KLGQRIAAFHVQVEVDGVWQEFGSGHTVGYKRLLRGAVVEAQKTRVVTTESQALPLLTKTSLYKTPGLSKKEVVQEL

AFAEKSLAVAKGENAYFTVKRRECSGPLEAKISIQPGTGVHGVAYQDEIQVLAFQTGETEKSLTLPTLYFAGDKTLD

FYLNLTVDGQLVDQLQVQVSZ

ID208 - 4125.12 (SEQ. ID. NO. 175)
ATGCTTGAAAGACTGAAAAGAATACATTATATGTTTTGGATCAGTTTAATTTTTATGATTTTCCCCATCCTGTCTGT

AGTGACTGGGTGGCTTTCTGCCTGGCATTTATTGATTGATATTCTATTTGTAGTGGCATATTTGGGTGTTTTAACAA

CTAAGAGCCAGCGCCTATCTTGGCTATATTGGGGCCTCATGCTGACTTATGTAGTTGGGAATACTGCCTTTGTTGCT

GTTAATTATATCTGGTTTTTCTTTTTCCTATCCAATCTCTTAAGTTATCATTTCAGCGTACGTAGTTTAAAGTCTTT

ACATGTCTGGACTTTTCTTCTTGCTCAAGTCCTTGTTGTGGGCAACTGTTGATTTTCAGAGAATCGAAGTTGAGT

TTCTATTCTATCTACTTGTAATTCTTACTTTTGTCGATTTAATGACTTTTGGATTGGTTCGGATTCGTATTGTCGAG

GATTTGAAAGAAGCTCAGGTCAAGCAAAATGCTCAGATAAATCTATTGCTTGCTGAAAATGAACGTAGTCGTATCGG

TCAGGATTTGCATGATAGTCTGGGACATACCTTTGCTATGCTGAGTGTCAAGACAGATTTAGCCTTGCAGTTATTTC

AGATGGAGCTTATCCACAGGTGGAAAGGAATTAAAGAAATTCACCAGATAGCAGGATCCATGA (SEQ. ID. NO. 159)
MLERLKRTHYMFWTSLTFMTFPTLSVVTGWLSAWHLLTDTLFVVAYLGVLTTKSQRLSWLYWGLMLTYVVGNTAFVA

VNYIWFFFFLSNLLSYHFSVRSLKSLHVWTFLLAQVLVVGQLLIFQRIEVEFLFYLLVILTFVOLMTFGLVRIRIVE

DLKEAQVKQNAQINLLLAENERSRIGQDLHDSLGHTFAMLSVKTDLALQLFQMEAYPQVEKELKEIHQISKDPZ

ID209 - 4126.3 (SEQ. ID. NO. 176)
ATGAATGATAAGTTAAAAATCTTCTTGTTGCTAGGAGTATTTTTTCTAGCCATAACCGGTTTCTATGTTCTATTGAT

ACGAAATGCAGGGCAGACAGATGCCTCGCAAATTGAAAAGGCGGCAGTTAGCCAAGGAGGAAAAGCAGTGAAAAAAA

CAGAAATTAGTAAAGACGCAGACTTGCACGAAATTTATCTAGCTGGAGGTTGTTTCTGGGGAGTGGAGGAATATTTC

TCACGTGTTCCCGGGGTGACGGATGCCGTTTCAGGCTATGCAAATGGTAGAGGAGAAACAACCAAGTACGAATTGAT

TAACCAAACAGGTCATGCAGAAACCGTCCATGTCACCTATGATGCCAAGCAAATTTCTCTCAAGGAAATCCTGCTTC

ACTATTTCCGCATTATCAATCCAACCAGCAAA)ATAAACAAGGAAATGATGTGGGGACCCAGTACCGTACTGGTGTT

TATTACACAGATGACAAGGATTTGGAAGTGATTAACCAAGTCTTTGATGAGGTGGCTAAGAAATACGATCAACCTCT

AGCAGTTGAAAAGGAAAACTTGAAGAATTTTGTGGTGGCTGAGGATTACCATCAAGACTATCTAAAGAAAAATCCAA

ATGGCTACTGCCATATCAATGTTAATCAGGCGGCCTATCCTGTCATTGATGCCAGCAAATATCCAAAACCAAGTGAT

GAGGAATTGAAAAAGACCCTGTCACCTGAGGAGTATGCAGTTACCCAGGAAAATCAAACAGAACGAGCTTTCTCAAA

CCGTTACTGGGATAAATTTGAATCCGGTATCTATGTGGATATAGCAACTGGGGAACCTCTCTTTTCATCAAAAGACA

AATTTGAGTCTGGTTGTGGCTGGCCTAGTTTTACCCAACCCATCAGTCCAGATGTTGTCACCTACAAGGAAGATAAG

TCCTACAATATGACGCGTATGGAAGTGCGGAGCCGAGTAGGAGATTCTCACCTTGGGCATGTCTTTACGGATGGTCC

ACAGGACAAGGGCGGCTTACGTTACTGTATCAATAGCCTCTCTATCCGCTTTATTCCCAAAGACCAAATGGAAGAAA

AAGgcTACGCTTATTTACTAGATTATGTTGATTAA (SEQ. ID. NO. 160)
MNDKLKIFLLLGVFFLAITGFYVLLIRNAGQTDASQIEKAAVSQGGKAVKKTEISKDADLHETYTAGGCFWGVEEYF

SRVPGVTDAVSGYANGRGETTKYELINQTGHAETVHVTYDAKQISLKEILLHYFRIINPTSKNKQGNDVGTQYRTGV

YYTDDKDLEVINQVFDEVAKKYDQPLAVEKENLKNFVVAEDYHQDYLKKNPNGYCHINVNQAAYPVIDASKYPKPSD

EELKKTLSPEEYAVTQENQTERAFSNRYWDKFESGIYVDIATGEPLFSSKDKFESGCGWPSFTQPISPDVVTYKEDK

SYNMTRMEVRSRVGDSHLGMVFTDGPQDKGGLRYCINSLSIRFIPKDQMEEKGYAYLLDYVDZ

TABLE 3-continued

ID210 - 4127.1 (SEQ. ID. NO. 177)
ATGAAAAAGAAATGGATGTATTATGCTGCTTGTTCTTCTAATGAATCTGCCGATGACAGTTCATCTGATAAAGGAGA

CGGCGGTTCGCTAGTCGTTTATTCACCAAACTCAGAGGGCTTAATTGGAGCAACTATTCCTGCCTTTGAAGAAAAT

ATGGTATCAAAGTAGAACTGATTCAAGCTGGTACTGGAGAACTTTTCAAAA)ACTAGAGTCAGAAAAAGAAGTTCCT

GTAGCTGATGTTATCTTTGGTGGTTCTTATACACAATATACTACCCACGGAGAACTCTTTGAAAACTATACTTCAAA

AGAAAATGATAATGTTATCAAAGAATATCAAAACACAACTCGCTACTCTACTCCTTATACACTAGATGGTAGTGTTT

TAATCGTCAACCCTGATTTAACTAAAGGCATGAACATCGAAGGTATAACGATCTTTTCAAACCTGAACTAAAAGGA

AAAATCGCAACTGCTGACCCAGCAAACTCTTCTAGCGCCTTTGCTCAATTAACAAATATGCTACAAGCTCAAGGTGG

TTAACAAAGATGATAAGGCTTGGTCTTATGTAAAAGATCTTTTCACACTTATTGATGGTAAAATCGGTTCAGTTCAT

CTAGTGTCTATAAAGTAGTCGCTGATGGAGAAATGGCTGTTGGTCTCTCTTATGAAGATCCAGCAGTTAAACTCTTA

AATGACGGAGCTAACATTAAGGTAGTCTATCCAAAAGAAGGAACCGTCTTCCTACCTGCTAGTGCTGCTATCGTTAA

AAAATCTAAAAATATGGAAAATGCCAAGAAATTTATCGATTTTATTATCTCTCAAGAAGTACAAGATACACTTGGTA

CAACCACTACTAACCGTCCTGTTCGTAAAAATGCTAAAACAAGCGAAAACATGAAACCAATTGACAAAATCAAAACA

CTCACTGAAGATTATGATTATGTCATCAAGAATAAATCAGATATCGTTAAGAAATACAACGAAGTCTTTACAGATAT

CCAATCTAAACAGTAA (SEQ. ID. NO. 161)
MKKKWMYYAACSSNESADDSSSDKGDGGSLVVYSPNSEGLIGATIPAFEEKYGIKVELIQAGTGELFKKLESEKEVP

VADVIFGGSYTQYTTHGELFENYTSKENDNVIKEYQNTTGYSTPYTLDGSVLIVNPDLTKGMNIEGYNDLFKPELKG

KIATADPANSSSAFAQLTNMLQAQGGYKDDKAWSYVKDLFTLIDGKIGSSSSSVYKVVADGEMAVGLSYEDPAVKLL

NDGANIKVVYPKEGTVFLPASAAIVKKSKNMENAKKFIDFIISQEVQDTLGTTTTNRPVRKNAKTSENMKPIDKIKT

LTEDYDYVIKNKSDIVKKYNEVFTDIQSKQZ

ID211 - 4127.2 (SEQ. ID. NO. 178)
ATGAGTGAGATCAAAATTATTAACGCCAAAAAAATCTACCACGATGTCCCTGTTATTGAGAATTTGAACATTACAAT

TCCAAAAGGAAGTCTCTTTACCCTTCTTGGAGCTTCAGGATGTGGGAAAACGACCCTTCTTCGTATGATTGCAGGTT

TCAACAGTATCGAAGGTGGAGAATTTTACTTCGATGATACAAAAATCAATAATATGGAACCCAGCAAACGCAATATC

GGGATGGTTTTCCAAAACTACGCTATTTTCCCACATTTGACTGTCCGAGACAACGTTGCTTTTGGTCTTATGCAAAA

GAAGGTTCCAAAAGAAGAATTGATTCAACAGACCAACAAGTATCTTGAACTCATGCAAATTGCTCAATATGCGGATC

GAAAGCCCGATAAACTCAGTGGTGGACAACAACAACGTGTCACCTTGGCATGCGCCTTAGCGGTTAATCCAAGTGTT

CTCCTCATGGACGAGCCACTTAGTAATCTGGAGGCCAAACTTCGCTTGGATATGCGTCAAGCCATCCGAGAAATCCA

ACACGAAGTGGGAATTACAACTGTTTATGTAACCCACGACCAAGAAGAAGCCATGGCTATTTCAGACCAAATTGCTG

TTATGAAAGATGGGGTGATCCAACAAATCGGCCGACCAAAAGAACTCTATCATAAACCAGCTAATGAGTTTGTGGCA

ACCTTTATCGGACGCACAAATATTATCCCTGCCAATCTTGAAAAACGGAGCGACGGCGCTTATATCGTCTTTTCAGA

TGGCTATGCCCTTCGAATGCCAGCTCTTGATCAGGTTGAGGAGCAAGCTATTCATGTAAGCATTCGTCCCGAAGAGT

TTATCAAAGATGAATCTGGAGATATTGAAGGAACTATTAGAGATAGCGTCTATCTTGGACTAAATACGGATTATTTC

ATTGAGACAGGTTTTGCCTCAAAAATTCAAGTTAGTGAAGAATCAACTTTTGAAGAAGATCTACAAAAAGGCAATCG

TATTCGTCTACGAATCAATACGCAAAAATTAAACATCTTTTCTGCAGATGGTTCCCAAAACCTGATAAAAGGAGTCA

ACCATGGAACGTAA (SEQ. ID. NO. 162)
MSEIKIINAKKIYHDVPVIENLNITIPKGSLFTLLGASGCGKTTLLRMIAGFNSIEGGEFYFDDTKINNMEPSKRNI

GMVFQNYAIFPHLTVRDNVAFGLMQKKVPKEELIQQTNKYLELMQIAQYADRKPDKLSGGQQQRVTLACALAVNPSV

LLMDEPLSNLEAKLRLDMRQAIREIQHEVGITTVYVTHDQEEAMAISDQIAVMKDGVIQQIGRPKELYHKPANEFVA

TABLE 3-continued

TFIGRTNIIPANLEKRSDGAYIVFSDGYALRMPALDQVEEQAIHVSIRPEEFIKDESGDIEGTIRDSVYLGLNTDYF
IETGFASKIQVSEESTFEEDLQKGNRIRLRINTQKLNIFSADGSQNLIKGVNHGTZ

ID212 - 4136.1 (SEQ. ID. NO. 179)
ATGAAGAAAAAATTATTGGCAGGTGCCATCACACTATTATCAGTAGCAACTTTAGCACGTTGTTCGAAAGGGTCAGA
AGGTGCAGACCTTATCAGCATGAAAGGGGATGTCATTACAGAACATCAATTTTATGAGCAAGTGAAAACGAACCCTT
CAGCCCAACAAGTCTTGTTAAATATGACCATCCAAAAAGTTTTTGAAAAACAATATGGCTCAGAGCTTGATGATAAA
GAGGTTGATGATACTATTGCCGAAGAAAAAAACAATATGGCGAAAACTACCAACGTGTCTTGTCACAAGCAGGTAT
GACTCTTGAAACACGTAAAGCTCAAATTCGTACAAGTAAATTAGTTGAGTTGGCAGTTAAGAAGGTAGCAGAAGCTG
AATTGACAGATGAAGCCTATAAGAAAGCCTTTGATGAGTACACTCCAGATGTAACGGCTCAAATCATCCGTCTTAAT
AATGAAGATAAGGCCAAAGAAGTTCTCGAAAAAGCCAAGGCAGAAGGTGCTGATTTTGCTCAATTAGCCAAAGATAA
TTCAACTGATGAAAAAACAAAAGAAAATGGTGGAGAAATTACCTTTGATTCTGCTTCAACAGAAGTACCTGAGCAAG
TCAAAAAAGCCGCTTTCGCTTTAGATGTGGATGGTGTTTGTGATGTGATTACAGCAACTGGCACACAAGCCTACAGT
AGCCAATATTACATTGTAAAACTCACTAAGAAAACAGAAAAATCATCTAATATTGATGACTACAAAGAAAAATTAAA
AACTGTTATCTTGACTCAAAAACAAAATGATTCAACATTTGTTCAAAGCATTATCGGAAAAGAATTGCAAGCAGCCA
ATATCAAGGTTAAGGACCAAGCCTTCCAAAATATCTTTACCCAATATATCGGTGGTGGAGATTCAAGCTCAAGCAGT
AGTACATCAAACGAATAG (SEQ. ID. NO. 163)
MKKKLLAGAITLLSVATLAACSKGSEGADLISMKGDVITEHQFYEQVKSNPSAQQVLLNMTIQKVFEKQYGSELDDK
EVDDTIAEEKKQYGENYQRVLSQAGMTLETRKAQIRTSKLVELAVKKVAEAELTDEAYKKAFDEYTPDVTAQIIRLN
NEDKAKEVLEKAKAEGADGAQLAKDNATDEKTKENGGEITFDSASTEVPEQVKKAAFALDVDGVSDVITATGTQAYS
SQYYIVKLTKKTEKSSNIDDYKEKLKTVILTQKQNDSTFVQSIIGKELQAANIKVKDQAFQNIFTQYIGGGDSSSSS
STSNEZ

ID213 - 4137.3 (SEQ. ID. NO. 180)
ATGAAAAAAAATATTAAACAATATGTAACCTTAGGTACTGTAGTGGTATTATCAGCATTTGTTGCTAACTCAGTTGC
AGCTCAGGAGACTGAAACTTCTGAAGTATCAACACCAAAGTTGGTGCAACCTGTTGCACCAACGACTCCGATTTCGG
AAGTACAACCTACATCGGATAACTCTTCGGAAGTTACTGTACAACCTCGAACAGTTGAAACTACTGTTAAGGATCCA
TCTTCTACAGCGGAAGAAACTCCTGTCTTAGAAAAAAATAATGTTACTTTAACAGGGGGCGGAGAAAATGTTACTAA
AGAGTTAAAGGATAAATTTACTAGCGGTGACTTTACTGTAGTGATTAAGTACAATCAGTCAAGTGAGAAAGGCTTAC
AAGCTCTGTTTGGAATATCTAATTCCAAACCCGGTCAACAAAATAGTTATGTAGATGTGTTCCTTAGAGACAATGGT
GAGTTGGGGATGGAAGCGCGTGATACTTCTTCCAATAAAAATAACCTAGTATCCAGACCTGCTTCAGTTTGGGGTAA
GTACAAACAAGAGGCTGTGACTAACACTGTTGCAGTAGTAGCAGATTCAGTCAAAAAAACATATTCTTTATACGCAA
ATGGTACAAAAGTAGTAGAAAAGAAAGTGGATAATTTCCTAAACATCAAGGATATTAAAGGTATTGATTACTATATG
CTTGGGGGAGTGAAACGTGCAGGAAAAACGGCGTTTGGTTTTAACGGAACACTAGAAAATATCAAATTCTTTAATAG
TGCATTGGATGAAGAAACTGTTAAAAAGATGACAACAAACGCTGTTACTGGACATTTAATTTATACGGCTAATGATA
CAACAGGTTCTAACTATTTCCGTATTCCAGTTCTGTATACTTTTAGCAATGGTCGGGTATTTTCAACGATTGACGCT
CGTTACGGTGGAACTCATGATTTCTTGAATAAAATTAATATTGCTACAAGTTATAGTGATGATAATGGTAAGACATG
GACTAAACCAAAATTAACATTGGCATTCGATGATTTTGCGCCAGTACCATTAGAATGGCCTCGTGAAGTTGGTGGAC
GTGACTTACAAATCAGCGGTGGTGCAACCTATATTGACTCTGTTATTGTGAAAAAAAGAACAAACAAGTACTCATG
TTTGCTGATGTGATGCCTGCTGGAGTAAGTTTTAGAGAAGCAACTAGAAAAGATTCAGGTTATAAACAAATTGATGG
TAATTATTACCTTAAATTAAGGAAACAAGGTGATACTGATTACAATTATACTATTCGTGAGAATGGTACTGTATACG

TABLE 3-continued

ACGATCGTACCAACAGACCAACTGAATTTTCAGTAGATAAAAATTTCGGTATTAAACAAAATGGTAATTATTTGACG

GTAGAGCGG (SEQ. ID. NO. 164)
MKKNIKQYVTLGTVVVLSAFVANSVAAQETETSEVSTPKLVQPVAPTTPISEVQPTSDNSSEVTVQPRTVETTVKDP

SSTAEETPVLEKNNVTLTGGGENVTKELKDKFTSGDFTVVIKYNQSSEKGLQALFGISNSKPGQQNSYVDVFLRDNG

ELGMEARDTSSNKNNLVSRPASVWGKYKQEAVTNTVAVVADSVKKTYSLYANGTKVVEKKVDNFLNIKDIKGIDYYM

LGGVKRAGKTAFGFNGTLENIKFFNSALDEETVKKMTTNAVTGHLIYTANDTTGSNYFRIPVLYTFSNGRVFSSIDA

RYGGTHDFLNKINIATSYSDDNGKTWTKPKLTLAFDDFAPVPLEWPREVGGRDLQISGGATYIDSVIVEKKNKQVLM

FADVMPAGVSFREATRKDSGYKQIDGNYYLKLRKQGDTDYNYTIRENGTVYDDRTNRPTEFSVDKNFGIKQNGNYLT

VER

ID214 - 4185 (SEQ. ID. NO. 181)
ATGAAAAAATTTAGCCTATTACTAGCTATCCTACCATTTTTGGTTGCCTGTGAGAATCAAGCTACACCCAAAGAGAC

TAGCGCTCAAAAGACAATCGTCCTTGCTACAGCTGGCGACGTGCCACCATTTGACTACGAAGACAAGGGCAATCTGA

CAGGCTTTGATATCGAAGTTTTAAAGGCAGTAGATGAAAAACTCAGCGACTACGAGATTCAATTCCAAAGAACCGCC

TGGGAGAGCATCTTCCCAGGACTTGATTCTGGTCACTATCAGGCTGCGGCCAATAACTTGAGTTACACAAAAGAGCG

TGCTGAAAAATACCTTTACTCGCTTCCAATTTCCAACAATCCCCTCGTCCTTGTCAGCAACAAGAAAAATCCTTTGA

CTTCTCTTGACCAGATCGCTGGTAAAACAACACAAGAGGATACCGGAACTTCTAACGCTCAATTCATCAATAACTGG

AATCAGAAACACACTGATAATCCCGCTACAATTAATTTTTCTGGTGAGGATATTGGTAAACGAATCCTAGACCTTGC

TAACGGAGAGTTTGATTTCCTAGTTTTTGACAAGGTATCCGTTCAAAAGATTATCAAGGACCGTGGTTTAGACCTCT

CAGTCGTTGATTTACCTTCTGCAGATACGGGGAGCAATTATATCATTTTCTCAAGCGACCAAAAAGAGTTTAAAGAG

CAATTTGATAAAGCGCTCAAAGAACTCTATCAAGACGGAACCCTTGAAAAACTCAGCAATACCTATCTAGGTGGTTC

TTACCTCCCAGATCAATCTCAGTTACAATAA (SEQ. ID. NO. 165)
MKKFSLLLAILPFLVACENQATPKETSAQKTIVLATAGDVPPFDYEDKGNLTGFDIEVLKAVDEKLSDYEIQFQRTA

WESIFPGLDSGHYQAAANNLSYTKERAEKYLYSLPISNNPLVLVSNKKNPLTSLDQIAGKTTQEDTGTSNAQFINNW

NQKHTDNPATINFSGEDIGKRILDLANGEFDFLVFDKVSVQKIIKDRGLDLSVVDLPSADSPSNYIIFSSDQKEFKE

QFDKALKELYQDGTLEKLSNTYLGGSYLPDQSQLQZ

ID215 - 4211.1 (SEQ. ID. NO. 182)
ATGAAAAAAAATAGTTTATATATCATATCCTCACTCTTTTTTGCTTGTGTCTTATTTGTCTATGCTACGGCGACGAA

TTTTCAAAACAGTACCAGTGCTAGGCAGGTAAAAACGGAAACCTATACTAATACAGTAACAAATGTCCCTATTGACA

TACGCTATAATAGTGATAAGTATTTTATTAGCGGTTTTGCTTCAGAAGTATCAGTGGTCTTGACTGGTGCAAATCGC

CTATCGCTAGCTAGTGAAATGCAAGAAAGTACACGTAAATTCAAGGTTACTGCTGACCTAACAGATGCCGGTGTTGG

AACGATTGAAGTTCCTTTGAGCATTGAAGATTTACCCAATGGGCTGACCGCTGTGGCGACTCCGCAAAAAATTACAG

TCAAGATTGGTAAGAAGGCTCAGAAGGATAAGGTAAAGATTGTACCAGAGATTGACCCTAGTCAAATTGATAGTCGG

GTACAAATTGAAAATGTCATGGTGTCAGATAAAGAAGTGTCTATTACGAGTGACCAAGAGACATTGGATAGAATTGA

TAAGATTATCGCTGTTTTGCCAACTAGCGAACGTATAACAGGTAATTACAGTGGTTCAGTACCTTTGCAGGCAATCG

ACCGCAATGGTGTTGTCTTACCGGCAGTTATCACTCCGTTTGATACAATAATGAAGGTGACTACAAAACCAGTAGCA

CCAAGTTCAAGCACATCAAATTCAAGTACAAGCAGTTCATCGGAGACATCTTCGTCAACGAAACGAACTAGTTCAAA

AACGAATTAA (SEQ. ID. NO. 166)
MKKNSLYIISSLFFACVLFVYATATNFQNSTSARQVKTETYTNTVTNVPIDIRYNSDKYFISGFASEVSVVLTGANR

LSLASEMQESTRKFKVTADLTDAGVGTIEVPLSIEDLPNGLTAVATPQKITVKIGKKAQKDKVKIVPEIDPSQIDSR

TABLE 3-continued

VQIENVMVSDKEVSITSDQETLDRIDKIIAVLPTSERITGNYSGSVPLQAIDRNGVVLPAVITPFDTIMKVTTKPVA

PSSSTSNSSTSSSSETSSSTKATSSKTNZ

ID216 - 4127.3 (SEQ. ID. NO. 183)
ATGTTGATTGGCGAAGGGTATCGGACTTTCCCTGTCCTGATTTATACCCAATTTATTAGCGAGGTTGGAGGAAATTC

TGCTTTTGCAATTATGGCGATTATCATTGCCTTGGCAATTTTCCTTATCCAAAAACACATTGCAAACCGCTACAGTT

TCAGCATGAATCTGCTCCATCCAATTGAGCCTAAAAAAACTACAAAAGGAAAAATGGCTGCCATTTATGCAACAGTC

TACGGAATTATCTTTATCTCTGTTTTACCTCAAATCTACTTAATTTATACCTCTTTCCTAAAAACATCAGGTATGGT

ATCTGTTAAAGGTTATTCTCCAAACAGTTACAAGGTAGCTTTCCATCGTATGGGATCTGCTATTTTCAATACCATTC

GTATCCCTTTGATTGCCTTAGTTCTAGTTGTTCTATTTGCGACATTTATCTCCTACCTAGCCGTTAGAAAACGGAAT

TTGTTTACAAACTTAATTGACAGCCTCAGTATGGTACCTTATATTGTACCAGGAACCGTTCTAGGGATTGCCTTCAT

TTCTTCCTTCAATACTGGTCTATTTGGAAGTGGATTTCTTATGATTACAGGGACTGCTTTCATCTTGATTATGTCTC

TATCTGCCAGAAGATTACCTTATACTATTCGCTCATCTGTTGCTAGCTTACAACAAATAGCACCAAGTATTGAAGAA

GCTGCTGAAAGCTTAGGAAGTAGTCGTCTCAATACCTTTGCTAAGATTACAACTCCAATGATGCTATCTGGTATCAT

TTCTGGAGCCATCTTATCTTGA (SEQ. ID. NO. 167)
MLIGEGYRTFPVLIYTQFISEVGGNSAFAIMAIIIALAIFLIQKHIANRYSFSMNLLHPIEPKKTTKGKMAAIYATV

YGIIFISVLPQIYLIYTSFLKTSGMVSVKGYSPNSYKVAFHRMGSAIFNTIRIPLIALVLVVLFATFISYLAVRKRN

LFTNLIDSLSMVPYIVPGTVLGIAFISSFNTGLFGSGFLMITGTAFILIMSLSARRLPYTIRSSVASLQQIAPSIEE

AAESLGSSRLNTFAKITTPMMLSGIISGAILSZ

TABLE 4

ID301 (SEQ. ID. NO. 196)
ATGAATAAGAAAAAAATGATTTTAACAAGTCTAGCCAGCGTCGATATCTTAGGGGCTGGTTTTGTTACGTCTCAGCC

TACTTTTGTAAGAGCAGAAGAATCTCCACAAGTTGTCGAAAAATCTTCATTAGAAGAAATATGAGGAAGCAAAAG

CAAAAGCTGATACTGCCAAGAAAGATTACGAAACGGCTAAAAAGAAAGCAGAAGACGCTCAGAAAAAGTATGAAGAT

GATCAGAAGAGAACTGAGGAGAAAGCTCGAAAAGAAGCAGAAGCATCTCAAAAATTGAATGATGTGGCGCTTGTTGT

TCAAAATGCATATAAAGAGTACCGAGAAGTTCAAAATCAACGTAGTAAATATAAATCTGACGCTGAATATCAGAAAA

AATTAACAGAGGTCGACTCTAAAATAGAGAAGGCTAGGAAAGAGCAACAGGACTTGCAAAATAAATTTAATGAAGTA

AGAGCAGTTGTAGTTCCTGAACCAAATGCGTTGGCTGAGACTAAGAAAAAAGCAGAAGAAGCTAAAGCAGAAGAAAA

AGTAGCTAAGAGAAAATATGATTATGCAACTCTAAAGGTAGCACTAGCGAAGAAAGAAGTAGAGGCTAAGGAACTTG

AAATTGAAAAACTTCAATATGAAATTTCTACTTTGGAACAAGAAGTTGCTACTGCTCAACATCAAGTAGATAATTTG

AAAAAACTTCTTGCTGGTGCGGATCCTGATGATGGCACAGAAGTTATAGAAGCTAAATTAAAAAAAGGAGAAGCTGA

GCTAAACGCTAAACAAGCTGAGTTAGCAAAAAAACAAACAGAACTTGAAAAACTTCTTGACAGCCTTGATCCTGAAG

GTAAGACTCAGGATGAATTAGATAAAGAAGCAGAAGAAGCTGAGTTGGATAAAAAAGCTGATGAACTTCAAAATAAA

GTTGCTGATTTAGAAAAGAAATTAGTAACCTTGAAATATTACTTGGAGGGGCTGATCCTGAAGATGATACTGCTGC

TCTTCAAAATAAATTAGCTGCTAAAAAAGCTGAGTTAGCAAAAAAACAAACAGAACTTGAAAAACTTCTTGACAGCC

TTGATCCTGAAGGTAAGACTCAGGATGAATTAGATAAAGAAGCAGAAGAAGCTGAGTTGGATAAAAAAGCTGATGAA

CTTCAAAATAAAGTTGCTGATTTAGAAAAGAAATTAGTAACCTTGAAATATTACTTGGAGGGGCTGATTCTGAAGA

TGATACTGCTGCTCTTCAAAATAAATTAGCTACTAAAAAAGCTGAATTGGAAAAAACTCAAAAAGAATTAGATGCAG

CTCTTAATGAGTTAGGCCCTGATGGAGATGAAGAAGAAACTCCAGCGCCGGCTCCTCAACCAGAGCAACCAGCTCCT

TABLE 4-continued

```
GCACCAAAACCAGAGCAACCAGCTCCAGCTCCAAAACCAGAGCAACCAGCTCCTGCACCAAAACCAGAGCAACCAGC
TCCAGCTCCAAAACCAGAGCAACCAGCTCCAGCTCCAAAACCAGAGCAACCAGCTAAGCCGGAGAAACCAGCTGAAG
AGCCTACTCAACCAGAAAACCAGCCACTCCAAAAACAGGCTGGAAACAAGAAAACGGTATGTGGTATTTCTACAAT
ACTGATGGTTCAATGGCAATAGGTTGGCTCCAAAACAACGGTTCATGGTACTACCTAAACGCTAACGGCGCTATGGC
AACAGGTTGGGTGAAAGATGGAGATACCTGGTACTATCTTGAAGCATCAGGTGCTATGAAAGCAAGCCAATGGTTCA
AAGTATCAGATAAATGGTACTATGTCAACAGCAATGGCGCTATGGCGACAGGCTGGCTCCAATACAATGGCTCATGG
TACTACCTCAACGCTAATGGTGATATGGCGACAGGATGGCTCCAATACAACGGTTCATGGTATTACCTCAACGCTAA
TGGTGATATGGCGACAGGATGGGCTAAAGTCAACGGTTCATGGTACTACCTAAACGCTAACGGTGCTATGGCTACAG
GTTGGGCTAAAGTCAACGGTTCATGGTACTACCTAAACGCTAACGGTTCAATGGCAACAGGTTGGGTGAAAGATGGA
GATACCTGGTACTATCTTGAAGCATCAGGTGCTATGAAAGCAAGCCAATGGTTCAAAGTATCAGATAAATGGTACTA
TGTCAATGGCTTAGGTGCCCTTGCAGTCAACACAACTGTAGATGGCTATAAAGTCAATGCCAATGGTGAATGGGTTT
AA
```

(SEQ. ID. NO. 184)
MNKKKMILTSLASVAILGAGFVTSQPTFVRAEESPQVVEKSSLEKKYEEAKAKADTAKKDYETAKKKAEDAQKKYED
DQKRTEEKARKEAEASQKLNDVALVVQNAYKEYREVQNQRSKYKSDAEYQKKLTEVDSKIEKARKEQQDLQNKFNEV
RAVVVPEPNALAETKKKAEEEAKAEEEKVAKRKYDYATLKVALAKKEVEAKELEIEKLQYEISTLEQEVATAQHQVDNL
KKLLAGADPDDGTEVIEAKLKKGEAELNAKQAELAKKQTELEKLLDSLDPEGKTQDELDKEAEEAELDKKADELQNK
VADLEKEISNLEILLGGADPEDDTAALQNKLAAKKAELAKKQTELEKLLDSLDPEGKTQDELDKEAEEAELDKKADE
LQNKVADLEKEISNLEILLGGADSEDDTAALQNKLATKKAELEKTQKELDAALNELGPDGDEEETPAPAPQPEQPAP
APKPEQPAPAPKPEQPAPAPKPEQPAPAPKPEQPAPAPKPEQPAKPEKPAEEPTQPEKPATPKTGWKQENGMWYFYN
TDGSMAIGWLQNNGSWYYLNANGAMATGWVKDGDTWYYLEASGAMKASQWFKVSDKWYYVNSNGAMATGWLQYNGSW
YYLNANGDMATGWLQYNGSWYYLNANGDMATGWAKVNGSWYYLNANGAMATGWAKVNGSWYYLNANGSMATGWVKDG
DTWYYLEASGAMKASQWFKVSDKWYYVNGLGALAVNTTVDGYKVNANGEWVZ

ID302                                                                (SEQ. ID. NO. 197)
```
ATGTTTGCATCAAAAAGCGAAAGAAAAGTACATTATTCAATTCGTAAATTTAGTGTTGGAGTAGCTAGTGTAGTTGT
TGCCAGTCTTGTTATGGGAAGTGTGGTTCATGCGACAGAGAACGAGGGAGCTACCCAAGTACCCACTTCTTCTAATA
GGGCAAATGAAAGTCAGGCAGAACAAGGAGAACAACCTAAAAAACTCGATTCAGAACGAGATAAGGCAAGGAAAGAG
GTCCAGGAATATGTAAAAAAAATAGTGGGTGAGAGCTATGCAAAATCAACTAAAAAGCGACATACAATTACTGTAGC
TGCCAGTCTTGTTATGGGAAGTGTGGTTCATGCGACAGAGAACGAGGGAGCTACCCAAGTACCCACTTCTTCTAATA
AGATACTGATGATGGAGAGTCGATCAAAAGTAGATGAAGCTGTGTCTAAGTTTGAAAAGGACTCATCTTCTTCGTCA
AGTTCAGACTCTTCCACTAAACCGGAAGCTTCAGATACAGCGAAGCCAAACAAGCCGACAGAACCAGGAGAAAAGGT
AGCAGAAGCTAAGAAGAAGGTTGAAGAAGCTGAGAAAAAAGCCAAGGATCAAAAAGAAGAAGATCGTCGTAACTACC
CAACCATTACTTACAAAACGCTTGAACTTGAAATTGCTGAGTCCGATGTGGAAGTTAAAAAAGCGGAGCTTGAACTA
GTAAAAGTGAAAGCTAACGAACCTCGAGACGAGCAAAAAATTAAGCAAGCAGAAGCGGAAGTTGAGAGTAAACAAGC
TGAGGCTACAAGGTTAAAAAAAATCAAGACAGATCGTGAAGAAGCAGAAGAAGAAGCTAAACGAAGAGCAGATGCTA
GATGCGAAGTCTTCAGATTCTAGCGTAGGTGAAGAAACTCTTCCAAGCCCATCCCTGAAACCAGAAAAAAAGGTAGC
AGAAGCTGAGAAGAAGGTTGAAGAAGCTAAGAAAAAAGCCGAGGATCAAAAAGAAGAAGATCGCCGTAACTACCCAA
CCAATACTTAGAAAACGCTTGAACTTGAAATTGCTGAGTCCGATGTGGAAGTTAAAAAAGCGGAGCTTGAACTAGTA
AAAGAGGAAGCTAAGGAACCTCGAAACGAGGAAAAAGTTAAGCAAGCAAAAGCGGAAGTTGAGAGTAAAAAAGCTGA
GGCTACAAGGTTAGAAAAAATCAAGACAGATCGTAAAAAAGCAGAAGAAGAAGCTAAACGAAAAGCAGCAGAAGAAG
ATAAAGTTAAAGAAAAACCAGCTGAACAACCACAACCAGCGCCGGCTCCAAAAGCAGAAAAACCAGCTCCAGCTCCA
```

TABLE 4-continued

AAACCAGAGAATCCAGCTGAACAACCAAAAGCAGAAAAACCAGCTGATCAACAAGCTGAAGAAGACTATGCTCGTAG

ATCAGAAGAAGAATATAATCGCTTGACTCAACAGCAACCGCCAAAAACTGAAAAACCAGCACAACCATCTACTCCAA

AAACAGGCTGGAAACAAGAAAACGGTATGTGGTACTTCTACAATACTGATGGTTCAATGGCGACAGGATGGCTCCAA

AACAATGGCTCATGGTACTACCTCAACAGCAATGGCGCTATGGCGACAGGATGGCTCCAAAACAATGGTTCATGGTA

CTATCTAAACGCTAATGGTTCAATGGCAACAGGATGGCTCCAAAACAATGGTTCATGGTACTACCTAAACGCTAATG

GTTCAATGGCGACAGGATGGCTCCAATACAATGGCTCATGGTACTACCTAAACGCTAATGGTTCAATGGCGACAGGA

TGGCTCCAATACAATGGCTCATGGTACTACCTAAACGCTAATGGTGATATGGCGACAGGTTGGGTGAAAGATGGAGA

TACCTGGTACTATCTTGAAGCATCAGGTGCTATGAAAGCAAGCCAATGGTTCAAAGTATCAGATAAATGGTACTATG

TCAATGGCTCAGGTGCCCTTGCAGTCAACACAACTGTAGATGGCTATGGAGTCAATGCCAATGGTGAATGGGTAAAC

TAA (SEQ. ID. NO. 185)
MFASKSERKVHYSIRKFSVGVASVVVASLVMGSVVHATENEGATQVPTSSNRANESQAEQGEQPKKLDSERDKARKE

VEEYVKKIVGESYAKSTKKRHTITVALVENELNNIKNEYLNKIVESTSESQLQILMMESRSKVDEAVSGEKDSSSSS

SSDSSTKPEASDTAKPNKPTEPGEKVAEAKKKVEEAEKKAKDQKEEDRRNYPTITYKTLELEIAESDVEVKKAELEL

VKVKANEPRDEQKIKQAEAEVESKQAEATRLKKIKTDREEAEEEAKRRADAKEQGKPKGRAKRGVPGELATPDKKEN

DAKSSDSSVGEETLPSPSLKPEKKVAEAEKKVEEAKKKAEDQKEEDRRNYPTNTYKTLELEIAESDVEVKKAELELV

KEEAKEPRNEEKVKQAKAEVESKKAEATRLEKIKTDRKKAEEEAKRKAAEEDKVKEKPAEQPQPAPAPKAEKPAPAP

KPENPAEQPKAEKPADQQAEEDYARRSEEEYNRLTQQQPPKTEKPAQPSTPKTGWKQENGMWYFYNTDGSMATGWLQ

NNGSWYYLNSNGAMATGWLQNNGSWYYLNANGSMATGWLQNNGSWYYLNANGSMATGWLQYNGSWYYLNANGSMATG

WLQYNGSWYYLNANGDMATGWVKDGDTWYYLEASGAMKASQWFKVSDKWYYVNGSGALAVNTTVDGYGVNANGEWVN

Z

ID303                                                              (SEQ. ID. NO. 198)
ATGGTAAAAAGACGTATAAGGAGAGGGACGAGAGAACCTGAAAAAGTTGTTGTTCCTGAGCAATCATCTATTCCTTC

GTATCCTGTATCTGTTACATCTAACCAAGGAACAGATGTAGCAGTAGAACCAGCTAAAGCAGTTGCTCCAACAACAG

ACTGGAAACAAGAAAATGGTATGTGGTATTTTTATAATACTGATGGTTCCATGGCAACAGGTTGGGTACAAGTTAAT

AGTTCATGGTACTACCTCAACAGCAACGGTTCTATGAAAGTCAATCAATGGTTCCAAGTTGGTGGTAAATGGTATTA

TGTAAATACATCGGGTGAGTTAGCGGTCAATACAAGTATAGATGGCTATAGAGTCAATGATAATGGTGAATGGGTGC

GTTAA (SEQ. ID. NO. 186)
MVKRRIRRGTREPEKVVVPEQSSIPSYPVSVTSNQGTDVAVEPAKAVAPTTDWKQENGMWYFYNTDGSMATGWVQVN

SSWYYLNSNGSMKVNQWFQVGGKWYYVNTSGELAVNTSIDGYRVNDNGEWVRZ

ID304                                                              (SEQ. ID. NO. 199)
CTGAATACAAGTTTTGTTCATGCTGCTGATGGGATTCAATATGTCAFAGATGATACTAGAGATAAAGAAGAGGGAAT

AGAGTATGATGACGCTGACAATGGGGATATTATTGTAAAAGTAGCGACTAAACCTAAGGTAGTAACCAAGAAAATTT

CAAGTACGCGAATTCGTTATGAAAAAGATGAAACAAAAGACCGTAGTGAAAATCCTGTTACAATTGATGGAGAGGAT

GGCTATGTAACTACGACAAGGACCTACGATGTTAATCCAGAGACTGGTTATGTTACCGAACAGGTTACTGTTGATAG

AAAAGAAGCCACGGATACAGTTATCAAAGTTCCAGCTAAAAGCAAGGTTGAAGAAGTTCTTGTTCCATTTGCTACTA

AATATGAAGCAGACAATGACCTTTCTGCAGGACAGGAGCAAGAGATTACTCTAGGAAAGAATGGGAAAACAGTTACA

ACGATAACTTATAATGTAGATGGAAAGAGTGGACAAGTAACTGAGAGTACTTTAAGTCAAAAAAAAGACTCTCAAAC

AAGAGTTGTTAAAAAAAGAACCAAGCCCCAAGTTCTTGTCCAAGAAATTCCAATCGAAACAGAATATCTCGATGGCC

CAACTCTTGATAAAAGTCAAGAAGTAGAAGAAGTAGGAGAAATTGGTAAATTACTCTTACTACAATCTATACTGTAG

TABLE 4-continued (SEQ. ID. NO. 187)
LNTSFVHAADGIQYVRDDTRDKEEGIEYDDADNGDIIVKVATKPKVVTKKISSTRIRYEKDETKDRSENPVTIDGED

GYVTTTRTYDVNPETGYVTEQVTVDRKEATDTVIKVPAKSKVEEVLVPFATKYEADNDLSAGQEQEITLGKNGKTVT

TITYNVDGKSGQVTESTLSQKKDSQTRVVKKRTKPQVLVQEIPIETEYLDGPTLDKSQEVEEVGEIGKLLLLQSILZ

ID305                                                                (SEQ. ID. NO. 200)
ATGAAGCTTTTGAAAAAAATGATGCAAATCGCACTAGCCACATTTTTCTTCGGTTTGTTAGCGACAAATACAGTATT

TGCAGATGATTCTGAAGGATGGCAGTTTGTCCAAGAAAATGGTAGAACCTACTACAAAAAGGGGGATCTAAAAGAAA

CCTACTGGAGAGTGATAGATGGGAAGTACTATTATTTTGATCCTTTATCCGGAGAGATGGTTGTCGGCTGGCAATAT

ATACCTGCTCCACACAAGGGGGTTACGATTGGTCCTTCTCCAAGAATAGAGATTGCTCTTAGACCAGATTGGTTTTA

TTTTGGTCAAGATGGTGTATTACAAGAATTTGTTGGCAAGCAAGTTTTAGAAGCAAAAACTGCTACGAATACCAACA

AACATCATGGGAAGAATATGATAGCCAAGCAGAGAAACGAGTCTATTATTTTGAAGATCAGCGTAGTTATCATACT

TTAAAAACTGGTTGGATTTATGAAGAGGGTCATTGGTATTATTTACAGAAGGATGGTGGCTTTGATTCGCGCATCAA

CAGATTCACGGTTGGAGAGCTAGCACGTGGTTGGGTTAAGGATTACCCTCTTACGTATGATGAAGAGAAGCTAAAAG

CAGCTCCATGGTACTATCTAAATCCAGCAACTGGCATTATGCAAACAGGTTGGCAATATCTAGGTAATAGATGGTAC

TACCTCCATTCGTCAGGAGCTATGGCAACTGGCTGGTATAAGGAAGGCTCAACTTGGTACTATCTAGATGCTGAAAA

TGGTGATATGAGAACTGGCTGGCAAAACCTTGGGAACAAATGGTACTATCTCCGTTCATCAGGAGCTATGGCAACTG

GTTGGTATCAGGAAAGTTCGACTTGGTACTATCTAAATGCAAGTAATGGAGATATGAAAACAGGCTGGTTCCAAGTC

AATGGTAACTGGTACTATGCCTATGATTCAGGTGCTTTAGCTGTTAATACCACAGTAGGTGGTTACTACTTAAACTA

TAATGGTGAATGGGTTAAGTAA (SEQ. ID. NO. 188)
MKLLKKMMQIALATFFFGLLATNTVFADDSEGWQFVQENGRTYYKKGDLKETYWRVIDGKYYYFDPLSGEMVVGWQY

IPAPHKGVTIGPSPRIEIALRPDWFYFGQDGVLQEFVGKQVLEAKTATNTNKHHGEEYDSQAEKRVYYFEDQRSYHT

YLHSSGAMATGWYKEGSTWYYLDAENGDMRTGWQNLGNKWYYLRSSGAMATGWYQESSTWYYLNASNGDMKTGWFQV

NGNWYYAYDSGALAVNTTVGGYYLNYNGEWVKZ

ID306                                                                (SEQ. ID. NO. 201)
TTGGCTGGTAGATATGGTTCTGCTGTTCAGTGTACAGAAGTGACTGCCTCAAACCTTTCAACAGTTAAAACTAAAGC

TACGGTTGTAGAAAAACCACTGAAAGATTTTAGAGCGTCTACGTCTGATCAGTCTGGTTGGGTGGAATCTAATGGTA

AATGGTATTTCTATGAGTCTGGTGATGTGAAGACAGGTTGGGTGAAAACAGATGGTAAATGGTACTATTTGAATGAC

TTAGGTGTCATGCAGACTGGATTTGTAAAATTTTCTGGTAGCTGGTATTACTTGAGCAATTCAGGTGCTATGTTTAC

AGGCTGGGGAACAGATGGTAGCAGATGGTTCTACTTTGACGGCTCAGGAGCTATGAAGACAGGCTGGTACAAGGAAA

ATGGCACTTGGTATTACCTTGACGAAGCAGGTATCATGAAGACAGGTTGGTTTAAAGTCGGACCACACTGGTACTAT

GCCTACGGTTCAGGAGCTTTGGCTGTGAGCACAACAACACCAGATGGTTACCGTGTAAATGGTAATGGTGAATGGGT

AAACTAG (SEQ. ID. NO. 189)
LAGRYGSAVQCTEVTASNLSTVKTKATVVEKPLKDFRASTSDQSGWVESNGKWYFYESGDVKTGWVKTDGKWYYLND

LGVMQTGFVKFSGSWYYLSNSGAMFTGWGTDGSRWFYFDGSGAMKTGWYKENGTWYYLDEAGIMKTGWFKVGPHWYY

AYGSGALAVSTTTPDGYRVNGNGEWVNZ

ID307                                                                (SEQ. ID. NO. 200)
ATGAAAATTTTGAAAAAAACTATGCAAGTTGGACTGACAGTATTTTTCTTTGGTTTGCTAGGGACCAGTACAGTATT

TGCAGATGATTCTGAAGGATGGCAGTTTGTCCAAGAAAACGGAAGAACCTACTACAAAAAGGGGGACCTCAAAGAAA

CCTACTGGCGAGTGATTGATGGTAAGTACTATTATTTTGATTCTCTATCTGGAGAGATGGTTGTCGGCTGGCAATAT

ATCCCGTTTCCATCTAAAGGTAGTACAATTGGTCCTTACCCAAATGGTATCAGATTAGAAGGTTTTCCAAAGTCAGA

TABLE 4-continued

```
GTGGTACTACTTCGATAAAAATGGAGTGCTACAAGAGTTTGTTGGTTGGAAAACATTAGAGATTAAAACTAAAGACA

GTGTTGGAAGAAAGTACGGGGAAAAACGTGAAGATTCAGAAGATAAAGAAGAGAAGCGTTATTATACGAACTATTAC

TTTAATCAAAATCATTCTTTAGACACACGTTCGCTTTATGATCAGTCTAACTCGTATTATCTAGCTAAGACGGAAAT

TAATGGAGAAAACTACCTTGGTGGTGAAAGACGTGCGGGGTGGATAAACGATGATTCGACTTGGTACTACCTAGATC

CAACAACTGGTATTATGCAAACAGGTTGGCAATATCTAGGTAATAAGTGGTACTACCTCCGTTCCTCAGGAGCAATG

GCCACTGGCTGGTATCAGGAAGGTACCACTTGGTATTATTTAGACCACCCAAATGGCGATATGAAAACAGGTTGGCA

AAACCTTGGGAACAAATGGTACTATCTCCGTTCATCAGGAGCTATGGCAACTGGTTGGTATCAAGATGGTTCAACTT

GGTACTACCTAAATGCAGGTAATGGAGACATGAAGACAGGTTGGTTCCAGGTCAATGGCAACTGGTACTATGCTTAT
```

(SEQ. ID. NO. 190)
```
MKILKKTMQVGLTVFFFGLLGTSTVFADDSEGWQFVQENGRTYYKKGDLKETYWRVIDGKYYYFDSLSGEMVVGWQY

IPFPSKGSTIGPYPRGIRLEGFPKSEWYYFDIOGVLQEFVGWKTLEILKTISVGRKYGEKREDSEDKEEKRYYTNYY

FNQNHSLETGWLYDQSNWYYLAKTEINGENYLGGERRAGWINDDSTWYYLDPTTGIMQTGWQYLGNKWYYLRSSGAM

ATGWYQEGTTWYYLDHPNGDMKTGWQNLGNKWYYLRSSGAMATGWYQDGSTWYYLNAGNGDMKTGWFQVNGNWYYAY

SSGALAVNTTVDGYSVNYNGEWVRZ
```

ID308                                                           (SEQ. ID. NO. 203)
```
ATGAAAAAGAAATTAACTAGTTTAGCACTTGTAGGCGCTTTTTTAGGTTTGTCATGGTATGGGAATGTTCAGGCTGA

AGAAAGTTCAGGAAATAAAATCCACTTTATCAATGTTCAAGAAGGTGGCAGTGATGCGATTATTCTTGAAAGCAATG

GACATTTTGCCATGGTGGATACAGGAGAAGATTATGATTTCCCAGATGGAAGTGATTCTCGCTATCCATGGAGAGAA

GGAATTGAAACGTCTTATAAGCATGTTCTAACAGACCGTGTCTTTCGTCGTTTGAAGGAATTGGGTGTCCAAAAACT

TGATTTTATTTTGGTGACCCATACCCACAGTGATCATATTGGAAATGTTGATGAATTACTGTCTACCTATCCAGTTG

ACCGAGTCTATCTTAAGAAATATAGTGATAGTCGTATTACTAATTCTGAACGTCTATGGGATAATCTGTATGGCTAT

GATAAGGTTTTACAGACTGCTGCAGAAAAAGGTGTTTCAGTTATTCAAAATATCACACAAGGGGATGCTCATTTTCA

GTTTGGGGACATGGATATTCAGCTCTATAATTATGAAAATGAAACTGATTCATCGGGTGAATTAAAGAAAATTTGGG

ATGACAATTCCAATTCCTTGATThGCGTGGTGAAAGTCAATGGCAAGAAAATTTACCTTGGGGCGATTTAGATAAT

GTTCATGGAGCAGAAGACAAGTATGGTCCTCTCATTGGAAAAGTTGATTTGATGAAGTTTAATCATCACCATGATAC

CAACAAATCAAATACCAAGGATTTCATTAAAAATTTGAGTCCGAGTTTGATTGTTCAAACTTCGGATAGTCTACCTT

GGAAAAATGGTGTTTGATAGTGAGTATGTTAATTGGCTCAAAGAACGAGGAATTGAGAGAATCACGCAGCCAGCAAA

GACTATGATGCAACAGTTTTTGATATTCGAAAAGACGGTTTTGTCAATATTTCAACATCCTACAAGCCGATTCCAAG

TTTTCAAGCTGGTTGGCATAAGAGTGCATATGGGAACTGGTGGTATCAAGCGCCTGATTCTACAGGAGAGTATGCTG

TCGGTTGGAATGAAATCGAAGGTGAATGGTATTACTTTAACCAAACGGGTATCTTGTTACAGAATCAATGGAAAAAA

TGGAACAATCATTGGTTCTATITGACAGACTCTGGTGCTTCTGCTAAAAATTGGAAGAAAATCGCTGGAATCTGGTA

TTATTTTAACAAAGAAAACCAGATGGAAATTGGTTGGATTCAAGATA)AGAGCAGTGGTATTATTTGGATGTTGATG

GTTCTATGAAGACAGGATGGCTTCAATATATGGGCAATGGTATTACTTTGCTCCATCAGGGGAAATGAAAATGGGC

TGGGTAAAAGATAAAGAAACCTGGTACTATATGGATTCTACTGGTGTCATGAAGACAGGTGAGATAGAAGTTGCTGG

TCAACATTATTATCTGGAAGATTCAGGAGCTATGAAGCAAGGCTGGCATAAAAAGGCAAATGATTGGTATTTCTACA

AGACAGACGGTTCACGAGCTGTGGGTTGGATCAAGGACAAGGATAAATGGTACTTCTTGAAAGAAAATGGTCAATTA

CTTGTGAACGGTAAGACACCAGAAGGTTATACTGTGGATTCAAGTGGTGCCTGGTTAGTGGATGTTTCGATCGAGAA

ATCTGCTACAATTAAAACTACAAGTCATTCAGAAATAAAAGAATCCAAAGAAGTAGTGAAAAAGGATCTTGAAAATA

AAGAAACGAGTCAACATGAAAGTGTTACAAATTTTTTCAACTAGTCAAGATTTGACATCCTCAACTTCACAAAGCTCT

GAAACGAGTGTAAACAAATCGGAATCAGAACAGTAG
```

TABLE 4-continued (SEQ. ID. NO. 191)
MKKKLTSLALVGAFLGLSWYGNVQAQESSGNKIHFINVQEGGSDAIILESNGHFAMVDTGEDYDFPDGSDSRYPWRE

GIETSYKHVLTDRVFRRLKELGVQKLDFILVTHTHSDHIGNVDELLSTYPVDRVYLKKYSDSRITNSERLWDNLYGY

DKVLQTAAEKGVSVIQNITQGDAHFQFGDMDIQLYNYENETDSSGELKKIWDDNSNSLISVVKVNGKKIYLGGDLDN

VHGAEDKYGPLIGKVDLMKFNHHHDTNKSNTKDFIKNLSPSLIVQTSDSLPWJGVDSRYVNWLKERGILERINAASK

DYDATVFDIRKDGFVNISTSYKPIPSFQAGWHKSAYGNWWYQAPDSTGEYAVGWNEIEGEWYYFNQTGILLQNQWKK

WNNHWFYLTDSGASAKNWKKIAGIWYYFNKENQMEIGWIQDKEQWYYLDVDGSMKTGWLQYMGQWYYFAPSGEMKMG

WVKDKETWYYMDSTGVMKTGEIEVAGQHYYLEDSGAMKQGWHKKANDWYFYKTDGSRAVGWIKDKDKWYFLKENGQL

LVNGKTPEGYTVDSSGAWLVDVSIEKSATIKTTSHSEIKESKEVVKKDLENKETSQHESVTMFSTSQDLTSSTSQSS

ETSVNKSESEQZ

ID309 (SEQ. ID. NO. 204)
ATGGAAATTAATGTGAGTAAATTAAGAACAGATTTGCCTCAAGTCGGCGTGCAACCATATAGGCAAGTACACGCACA

CTCAACTGGGAATCCGCATTCAACCGTACAGAATGAAGCGGATTATCACTGGCGGAAAGACCCAGAATTAGGTTTTT

TCTCGCACATTGTTGGGAACGGTTGCATCATGCAGGTAGGACCTGTTGATAATGGTGCCTGGGACGTTGGGGGCGGT

TGGAATGCTGAGACCTATGCAGCGGTTGAACTGATTGAAAGCCATTCAACCAAAGAAGAGTTCATGACGGACTACCG

CCTTTATATCGAACTCTTACGCAATCTAGCAGATGAAGCAGGTTTGCCGAAAACGCTTGATACAGGGAGTTTAGCTG

GAATTAAAACGCACGAGTATTGCACGAATAACCAACCAAACAACCACTCAGACCACGTTGACCCTTATCCATATCTT

GCTAAATGGGGCATTAGCCGTGAGCAGTTTAAGCATGATATTGAGAACGGCTTGACGATTGAAACAGGCTGGCAGAA

GAATGACACTGGCTACTGGTACGTACATTCAGACGGCTCTTATCCAAAAGACAAGTTTGAGAAAATCAATGGCACTT

GGTACTACTTTGACAGTTCAGGCTATATGCTTGCAGACCGCTGGAGGAAGCACACAGACGGCAACTGGTACTGGTTC

GACAACTCAGGCGAAATGGCTACAGGCTGGAAGAAAATCGCTGATAAGTGGTACTATTTCAACGAAGAAGGTGCCAT

GAAGACAGGCTGGGTCAAGTACAAGGACACTTGGTACTACTTAGACGCTAAAGAAGGCGCCATGGTATCAAATGCCT

TTATCCAGTCAGCGGACGGAACAGGCTGGTACTACCTCAAACCAGACGGAACACTGGCAGACAAGCCAGAATTCACA

GTAGAGCCAGATGGCTTGATTACAGTAAAATAA (SEQ. ID. NO. 192)
MEINVSKLRTDLPQVGVQPYRQVHAHSTGNPHSTVQNEADYHWRKDPELGFFSHIVGNGCIMQVGPVDNGAWDVGGG

WNAETYAAVELIESHSTKEEFMTDYRLYIELLRNLADEAGLPKTLDTGSLAGIKTHEYCTNNQPNNHSDHVDPYPYL

AKWGISREQFKHDIENGLTIETGWQKNDTGYWYVHSDGSYPKDKFEKINGTWYYFDSSGYMLADRWRKHTDGNWYWF

DNSGEMATGWKKIADKWYYFNEEGAMKTGWVKYKDTWYYLDAKEGAMVSNAFIQSADGTGWYYLKPDGTLADKPEFT

VEPDGLITVKZ

ID310 (SEQ. ID. NO. 205)
ATGGGCACAACAGGATTTACAATAATTGACTTAATTATCTTGATTGTTTATTTACTTGCGGTGTTGGTTGCAGGTAT

CTATTTCTCTAAAAAAGAGATGAAAGGAAAAGAGTTCTTTAAAGGAGATGGTTCGGTTCTTCGGTATGTTACTTCGG

TATCCATTTTTGCCACAATGCTCAGTCCGATTTCCTTCTTGGGACTCGCTGGTAGCTCTTATGCAGGTAGCTGGATT

TTATGGTTTGCTCAATTAGGGATGGTAGTAGCTATTCCACTGACAATTCGTTTTATCTTACCTATCTTTGCACGGAT

AGACATCGATACGGCATATGATTACTTGGATAAACGTTTTAATTCTAAAGCACTTCGTATTATTTCAGCACTCTTGT

TTATTATTTATCAATTGGGACGTATGTCTATCATTATGTACCTCCCATCAGCTGGTTTATCAGTATTCAGAGGAATT

GACATCAATATTTTGATTATTTTGATGGGTGTAGTTGCAATTGTTTATTCTTATACTGGTGGTCTAAAATCCGTATT

ATGGACAGACTTTATTCAAGGTGTGATTCTGATTAGTGGTGTCGTTTTAGCTTTATTTGTACTGATTGCTAATATTA

AAGGTGGCTTTGGTGCAGTAGCAGAAACATTAGCAAACGGGAAATTCCTTGCTGCAAATGAAAAACTTTTCGATCCT

AACTTGCTTTCAAACTCCATCTTTTTAATTGTGATGGGTTCAGGCTTTACAATCTTGTCTTCCTATGCTTCATCTCA

TABLE 4-continued

```
AGATTTGGTTCAACGTTTTACTACAACACAAAATATTAAGAAACTTAATAAGATGTTGTTCACAAAGCCTGTTTTGT
CACTTGCAACTGCAACAGTCTTTTACTTGATTGGTACAGGCTTGTACGTATTCTATCAAGTACAAAATGCAGATAGT
GCAGCTAGCAATATCCCTCAAGACCAAATCTTTATGTACTTTATTGCATACCAGTTACCAGTAGGTATCACAGGTTT
GATCTTGGCAGCGATTTATGCAGCATCTCAATCAACTATTTCAACAGGTTTGAACTCTGRTGCAACTTCATGGACAT
TGGATATTCAAGATGTCATTTCTAAAAATATGTCAGACAATCGTCGTACGAAAATTGCACAATTCGTATCTCTAGCA
GTAGGTTTATTCTCAATTGGTGTTTCCATTGTCATGGCTCACTCAGATATTAAATCTGCATACGAATGGTTCAATAG
TTTCATGGGACTTGTACTTGGTCTACTTGGTGGTGTATTTATTCTTGGATTTGTTTCTAAAAAAGCAAATAAACAAG
GTGCTTATGCAGCGCTGATTGTATCAACCATCGTCATGGTATTTATTAAATACTTCCTTCCTCCAACAGCTGTTAGC
TACTGGGCATATTCATTGATTTCAATCTCTGTATCAGTAGTTTCAGGTTATATTGTATCTGTTCTTACTGGAAATAA
AGTATCTGCACCTAAATATACAACGATRCATGATATTACAGAAATTAAAGCGGATTCAAGTTGGGAAGTTCGTCACT
AA
```

(SEQ. ID. NO. 193)
```
MGTTGFTIIDLIILIVYLLAVLVAGIYFSKKEMKGKEFFKGDGSVPWYVTSVSIFATMLSPISFLGLAGSSYAGSWI
LWFAQLGMVVAIPLTIRFILPIFARIDIDTAYDYLDKRFNSKALRIISALLFIIYQLGRMSIIMYLPSAGLSVLTGI
DINILIILMGVVAIVYSYTGGLKSVLWTDFIQGVILISGVVLALFVLIANIKGGFGAVAETLANGKFLAANEKLFDP
NLLSNSIFLIVMGSGFTILSSYASSQDLVQRFTTTQNIKKLN14LFTNGVLSLATAIVFYLIGTGLYVFYQVQNADS
AASNIPQDQIFMYFIAYQLPVGITGLILAAIYAASQSTISTGLNSVATSWTLDIQDVISKNMSDNRRTKIAQFVSLA
VGLFSIGVSIVMAHSDIKSAYEWFNSFMGLVLGLLGGVFILGFVSKKANKQGAYAALIVSTIVMVFIKYFLPPTAVS
YWAYSLISISVSVVSGYIVSVLTGNKVSAPKYTTIHDITEIKADSSWEVRHZ
```

ID311 (SEQ. ID. NO. 206)
```
ATGAAAATTAATAAAAAATATCTAGCAGGTTCAGTGGCAGTCCTTGCCCTAAGTGTTTGTTCCTATGAGCTTGGTCG
TCACCAAGCTGGTCAGGATAAGAAAGAGTCTAATCGAGTTGCTTATATAGATGGTGATCAGGCTCGTCAAAAGGCAG
AAAACTTGACACCAGATGAAGTCAGTAAGAGGGAGGGATCAACGCCGAACAAATCCTCATCAAGATTACGGATCAA
GGTTATGTGACCTCTCATGGAGACCATTATCATTACTATAATGGCAAGCTCCCTTATGATGCCATCATCAGTGAAGA
GCTCCTCATGAAAGATCCGAATTATCAGTTGAAGGATTCAGACATTGTCAATGAAATCAAGGGTGGTTATGTCATCA
AGGTAGACGGAAAATACTATGTTThCCTTAAGGATGCAGCTCATGCGGATAATATTCGGACAAAAGAAGAGATTAAA
CGTCAGAAGCAGGAACGCAGTCATAATCACGGGTCAGGAGCTAACGATCATGCAGTAGCTGCAGCCAGAGCCCAAGG
ACGCTATACAACGGATGATGGGTATATCTTCAATGCATCTGATATCATTGAGGACACGGGTGATGCTTATATCGTTC
CTCACGGCGACCATTACCATTACATTCCTAAGAATGAGTTATCAGCTAGCGAGTTAGCTGCTGCAGAAOCCTATTGG
AATGGGAAGCAGGGATCTCGTCCTTCTTCAAGTTCTAGTTATAATGCAAATCCAGCTCAACCAAGATTGTCAGAGAA
CCACAATCTGACTGTCACTCAAACTTATCATCAAAATCAAGGGGAAAACATTICAAGCCTTTTACGTGAATHGTATG
CTAAACCCTTATCAGAACGCCCATTGGAATCTGATGGCCTTATTTTCGACCCAGCGCAAATCACAAGTCGAACCCCC
AGAGGTGTAGCTGTCCCTCATGGTAACCATTACCACTTTATCCCTTATGAACAAATCTCTGAATTGGAAAAACGAAT
TGCTCGTATTATTCCCCTTCGTTATCGTTCAAACCATTGGGTACCAGATTCAAGACCAGAACAACCAAGTCCACAAT
CGACTCCGGAACCTAGTCCAAGTCCGCAACCTGCACCAAATCCTCAACCAGCTCCAAGCAATCCAATTGATGAGAAA
TTGGTCAAAGAAGCTGTTCGAAAAGTAGGCGATGGTTATGTCTTTGAGGAGAATGGAGTTTCTCGTTATATCCCAGC
CAAGGATCTTTCAGCAGAAACAGCAGCAGGCATTGATAGCAAACTGGCCAAGCAGGAAAGTTTATCTCATAAGCTAG
GAGCTAAGAAAACTGACCTCCCATCTAGTGATCGAGAATTTTACAATAAGGCTTATGACTTACTAGCAAGAATTCAC
CAAGATTTACTTGATAATAAAGGTCGACAAGTTGATTTYGAGGCTTTGGATAACCTGTTGGAACGACTCAAGGATGT
CCCAAGTGATAAAGTCAAGTTAGTGGATGATATTCTTGCCTTCTTAGCTCCGATTCGTCATCCAGAACGTTTAGGAA
AACCAAATGCGCAAATTACCTACACTGATGATGAGATTCAAGTAGCCAAGTTGGCAGGCAAGTACACAACAGAAGAC
```

TABLE 4-continued

```
GGTTATATCTTTGATCCTCGTGATATAACCAGTGATGAGGGGGATGCCTATGTAACTCCACATATGACCCATAGCCA
CTGGATTAAAAAAGATAGTTTGTCTGAAGCTGAGAGAGCGGCAGCCCAGGCTTATGCTAAAGAGAAAGGTTTGACCC
CTCCTTCGACAGACCATCAGGATTCAGGAAATACTGAGGCAAAAGGAGCAGAAGCTATCTACAACCGCGTGAAAGCA
GCTAAGAAGGTGCCACTTGATCGTATGCCTTACAATCTTCAATATACTGTAGAAGTCAAAAACGGTAGTTTAATCAT
ACCTCATTATGACCATTACCATAACATCAAATTTGAGTGGTTTGACGAAGGCCTTTATGAGGCACCTAAGGGGTATA
CTCTTGAGGATCTTTTGGCGACTGTCAAGTACTATGTCGAACATCCAAACGAACGTCCGCATTCAGATAATGGTTTT
GGTAACGCTAGCGACCATGTTCAAAGAAACAAAAATGGTCAAGCTGATACCAATCAAACGGAAAAACCAAGCGAGGA
GAAACCTCAGACAGAAAAACCTGAGGAAGAAACCCCTCGAGAAGAGAAACCGCAAAGCGAGAAACCAGAGTCTCCAA
AACCAACAGAGGAACCAGAAGAATCACCAGAGGAATCAGAAGAACCTCAGGTCGAGACTGAAAAGGTTGAAGAAAAA
CTGAGAGAGGCTGAAGATTTACTTGGAAAAATCCAGGATCCAATTATCAAGTCCAATGCCAAAGAGACTCTCACAGG
ATTAAAAAATAATTTACTATTTGGCACCCAGGACAACAATACTATTATGGCAGAAGCTGAAAAACTATTGGCTTTAT
TAAAGGAGAGTAAGTAA
```

(SEQ. ID. NO. 194)
```
MKINKKYLAGSVAVLALSVCSYELGRHQAGQDKKESNRVAYIDGDQAGQKAENLTPDEVSKREGINAEQIVIKITDQ
GYVTSHGDHYHYYNGKVPYDAIISEELLMKDPNYQLKDSDIVNEIKGGYVIKVDGKYYVYLKDAAHADNIRTKEEIK
RQKQERSHNHGSGANDHAVAAARAQGRYTTDDGYIFNASDIIEDTGDAYIVPHGDHYHYIPKNELSASELAAAEAYW
NGKQGSRPSSSSSYNANPAQPRLSENWNTTVTPTYHQNQGENISSLLRELYAKPLSERJVESDGLIFDPAOITSRTA
RGVAVPHGNHYHFIPYEQMSELEKRIARIIPLRYRSNHWVPDSRPEQPSPQSTPEPSPSPQPAP4PQPAPSNPIDEK
LVKEAVRKVGDGYVFEENGVSRYIPAKDLSAETAAGIDSKLAKQESLSHKLGAKKTDLPSSDREFYNKAYDLLARIH
QDLLDNKGRQVDFEALDNLLERLKDVPSDKVKLVDDILAFLAPIRHPERLGKPNAQITYTDDEIQVAKLAGKYTTED
GYIFDPRDITSDEGDAYVTPHMTHSHWIKKDSLSEAERAAAQAYAKEKGLTPPSTDHQDSGNTEAKGAEAIYNRNKA
AKKVPLDRMPYNLQYTVEVKNGSLIIPHYDHYHNIKFEWFDEGLYEAPKGYTLEDLLATVKYYVEHPNERPHSDNGF
GNASDHVQRNKNGQADTNQTEKPSEEKPQTEKPEEETPREEKPQSEKPESPKPTEEPEESPEESEEPQVETEKVEEK
LREAEDLLGKIQDPIIKSNAKETLTGLKNNLLFGTQDNNTIMAEAEKLLALLKESKZ
```

ID312                                                              (SEQ. ID. NO. 307)
```
ATGGAGGGATTGGTTAGAGTGCATTTATTGCCTGTATTTGGCGATTACAAGCTATCTAAACTTACTACGCCTATTCT
TCAACAGCAAGTAAACAAATGGGCTGACAAGGCAAATAAAGGCGAAAAAGGGGCATTTGCTAACTACTCTTTGCTCC
ATAACATGAATAAGCGTATTTTGAAATATGGCGTAGCTATCCAGGTAATACAATACAACCCAGCTAATGATGTCATC
GTTCCACGCAAACAGCAAAAAGAAAAGGCTGCTGTCAAATACTTAGACAACAAAGAATTAAAACAGTTTCTTGATTA
TTTAGATGCTCTGGATCAATCAAATTATGAGAACTTATTTGATGTTGTTCTGTATAAGACTTTATTGGCCACTGGTT
GCCGTATTAGTGAGGCTCTGGCTCTTGAATGGTCTGATATTGACCTAGAAAGCGGTGTTATCAGCATCAATAAGACA
CTAAACCGCTATCAGGAAATAAACTCACCTAAATCAAGCGCTGGTTATCGTGATATACCAATAGACAAAGCCACATT
ACTTTTACTGAAACAATACAAAAACCGTCAACAAATTCAGTCTTGGAAATTAGGCCGATCTGAAACAGTTGTATTCT
CTGTATTTACGGAGAAATATGCTTATGCTTGTAACTTACGCAAACGCCTAAATAAGCATTTTGATGCTGCTGGAGTA
ACTAACGTATCATTTCATGGTTTCCGCCATACACATACTACTATGATGCTCTATGCTCAGGTTAGCCCGAAAGATGT
TCAGTATAGATTAGGCCACTCTAATTTAATGATCACTGAAAATACTTACTGGCATACTAACCAAGAGAATGCAAAAA
AAGCCGTCTCAAATTATGAAACAGCTATCAACAATTTATAA
```

TABLE 4-continued (SEQ. ID. NO. 195)
MEGLVRVHLLPVFGDYKLSKLTTPILQQQVNKWADKANKGEKGAFANYSLLHNMNKRILKYGVAIQVIQYNPANDVI

VPRKQQKEKAAVKYLDNKELKQFLDYLDALDQSNYQNLFDVVLYKTLLATGCRISEALALEWSDIDLESGVISINKT

LNRYQEINSPKSSAGYRDIPIDKATLLLLKQYKNRQQIQSWKLGRSETVVFSVFTEKYAYACNLRKRLNKHFDAAGV

TNVSFHGFRHTHTTMMLYAQVSPKDVQYRLGHSNLMITENTYWHTNQENAKKAVSNYETAINNLZ

SEQUENCE LISTING (388 sequences)

SEQ ID NO: 1 - protein, 207 aa, Streptococcus pneumoniae
MEELVTLDCLFIDRTKIEANANKYSFVWKKTTEKFSAKLQEQIQVYFQEEITPLLIKYAMFDKKQKRGYKESAKNLANWHYNDKEDSYTHPDGWYYRFHHTKYQKTQTDFQQEIKVYYADEPESAPQKGLYMNERYQNLKAKECQALLSPQGRQIFAQRKIDVEPVFGQIKASLGYKRCNLRGKRQVRIDMGLVLMANNLLKYSKMK

SEQ ID NO: 2 - protein, 2233 aa, Streptococcus pneumoniae
MGKGHWNRKRVYSIRKFAVGACSVMIGTCAVLLGGNIAGESVVYADETLITHTAEKPKEEKMIVEEKADKALETKNIVERTEQSEPSSTEAIASEKKEDEAVTPKEEKVSAKPEEKAPRIESQASNQEKPLKEDAKAVTNEEVNQMIEDRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLQKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEIARDKITTAGKPAAVRLIKEDHAIAADGKDLTYIYYEIVDSQGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSSVDVSKPGIVTVKGMADGREVEARVEVIALKSELPVVKRIAPNTDLNSVDKSVSYVLIDGSVEEYEVDKWEIAEEDKAKLAIPGSRIQATGYLEGQPIHATLVVEEGNPAAPAVPTVTVGGEAVTGLTSQKPMQYRTLAYGAKLPEVTASAKNAAVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKDQVELTIQANTEKKIAQSIRPVNVVTDLHQEPSLPATVTVEYDKGFPKTHKVTWQAIPKEKLDSYQTFEVLGKVEGIDLEARAKVSVEGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNPSDPVSNVNDKLISYNNQPANRWTNWNRTNPEASVGVLFGDSGILSKRSVDNLSVGFHEDHGVGVPKSYVIEYYVGKTVPTAPKNPSFVGNEDHVFNDSANWKPVTNLKAPAQLKAGEMNHFSFDKVETYAVRIRMVKADNKRGTSITEVQIFAKQVAAAKQGQTRIQVDGKDLANFNPDLTDYYLESVDGKVPAVTASVSNNGLATVVPSVREGEPVRVIAKAENGDILGEYRLHFTKDKSLLSHKPVAAVKQARLLQVGQALELPTKVPVYFTGKDGYETKDLTVEWEEVPAENLTKAGQFTVRGRVLGSNLVAEITVRVTDKLGETLSDNPNYDENSNQAFASATNDIDKNSHDRVDYLNDGDHSENRRWTNWSPTPSSNPEVSAGVIFRENGKIVERTVTQGKVQFFADSGTDAPSKLVLERYVGPEFEVPTYYSNYQAYDADHPFNNPENWEAVPYRADKDIAAGDEINVTFKAIKAKAMRWRMERKADKSGVAMIEMTFLAPSELPQESTQSKILVDGKELADFAENRQDYQITYKGQRPKVSVEENNQVASTVVDSGEDSFPVLVRLVSESGKQVKEYRIHLTKEKPVSEKTVAAVQEDLPKIEFVEKDLAYKTVEKKDSTLYLGETRVEQEGKVGKERIFTAINPDGSKEEKLREVVEVPTDRIVLVGTKPVAQEAKKPQVSEKADTKPIDSSEASQTNKAQLPSTGSAASQAAVAAGLTLLGLSAGLVVTKGKKED

SEQ ID NO: 3 - protein, 470 aa, Streptococcus pneumoniae
MKIMKKKYWTLAILFFCLFNNSVTAQEIPKNLDGNITHTQTSESFSESDEKQVDYSNKNQEEVDQNKFRIQIDKTELFVTTDKHLEKNCCKLELEPQINNDIVNSESNNLLGEDNLDNKIKENVSHLDNRGGNIEHDKDNLESSIVRKYEWDIDKVTGGGESYKLYSKSNSKVSIAILDSGVDLQNTGLLKNLSNHSKNYVPNKGYLGKEEGEEGIISDIQDRLGHGTAVVAQIVGDDNINGVNPHVNINVYRIFGKSSASPDWIVKAIFDAVDDGNDIINLSTGQYLMIDGEYEDGTNDFETFLKYKKAIDYANQKGVIIVAALGNDSLNVSNQSDLLKLISSRKKVRKPGLVVDVPSYFSSTISVGGIDRLGNLSDFSNKGDSDAIYAPAGSTLSLSELGLNNFINAEKYKEDWIFSATLGGYTYLYGNSFAAPKVSGAIAMIIDKYKLKDQPYNYMFVKKFWKKHYQ

SEQ ID NO: 4 - protein, 335 aa, Streptococcus pneumoniae
MKKTWKVFLTLVTALVAVVLVACGQGTASKDNKEAELKKVDFILDWTPNTNHTGLYVAKEKGYFKEAGVDVDLKLPPEESSSDLVINGKAPFAVYFQDYMAKKLEKGAGITAVAAIVEHNTSGIISRKSDNVSSPKDLVGKKYGTWNDPTELAMLKTLVESQGGDFEKVEKVPNNDSNSITPIANGVFDTAWIYYGWDGILAKSQGVDANFMYLKDYVKEFDYYSPVIIANNDYLKDNKEEARKVIQAIKKGYQYAMEHPEEAADILIKNAPELKEKRDFVIESQKYLSKEYASDKEKWGQFDAARWNAFYKWDKENGILKEDLTDKGFTNEFVK

SEQ ID NO: 5 - protein, 335 aa, Streptococcus pneumoniae
MKRTWRNSFVTNLNTPFMIGNIEIPNRTVLAPMAGVTNSAFRTIAKELGAGLVVMEMVSDKGIQYNNEKTLHMLHIDEGENPVSIQLFGSDEDSLARAAEFIQENTKTDIVDINMGCPVNKIVKNEAGAMWLKDPDKIYSIINKVQSVLDIPLTVKMRTGWADPSLAVENALAAEAAGVSALAMHGRTREQMYTGHADLETLYKVAQALTKIPFIANGDIRTVQEAKQRIEEVGADAVMIGRAAMGNPYLFNQINHYFETGEILPDLTFEDKMKIAYEHLKRLINLKGENVAVREFRGLAPHYLRGTSGAAKLRGAISQASTLAEIETLLQLEKA

SEQ ID NO: 6 - protein, 442 aa, Streptococcus pneumoniae
MIKNPKLLTKSFLRSFAILGGVGLVIHIAIYLTFPFYYIQLEGEKFNESARVFTEYLKTKTSDEIPSLLQSYSKSLTISAHLKRDIVDKRLPLVHDLDIKDGKLSNYIVMLDMSVSTADGKQVTVQFVHGVDVYKEAKNILLLYLPYTFLVTIAFSFVFSYFYTKRLLNPLFYISEVTSKMQDLDDNIRFDESRKDEVGEVGKQINGMYEHLLKVIYELESRNEQIVKLQNQKVSFVRGASHELKTPLASLRIILENMQHNIGDYKDHPKYIAKSINKIDQMSHLLEEVLESSKFQEWTECRETTVKPVLVDILSRYQELAHSIGVTIENQLTDATRVVMSLRALDKVLTNLISNAIKYSDKNGRVIISEQDGYLSIKNTCAPLSDQELEHLFDIFYHSQIVTDKDESSGLGLYIVNNILESYQMDYSFLPYEHGMEFKISL

SEQ ID NO: 7 - protein, 475 aa, Streptococcus pneumoniae
MYLGDLMEKAECGQFSILSFLLQESQTTVKAVMEETGFSKATLTKYVTLLNDKALDSGLELAIHSEDENLRLSIGAATKGRDIRSLFLESAVKYQILVYLLYHQQFLAHQLAQELVISEATLGRHLAGLNQILSEFDLSIQNGRWRGPEHQIHYFYFCLFRKVWSSQEWEGHMQKPERKQEIANLEEICGASLSAGQKLDLVLWAHISQQRLRVNACQFQVIEEKMRGYFDNIFYLRLLRKVPSFFAGQHIPLGVEDGEMMIFFSFLLSHRILPLHTMEYILGFGGQLADLLTQLIQEMKKEELLGDYTEDHVTYELSQLCAQVYLYKGYILQDRYKYQLENRHPYLLMEHDFKETAEEIFHALPAFQQGTDLDKKILWEWLQLIEYMAENGGQHMRIGLDLTSGFLVFSRMAAILKRYLEYNRFITIEAYDPSRHYDLLVTNNPIHKKEQTPVYYLKNDLDMEDLVAIRQLLFT

SEQ ID NO: 8 - protein, 608 aa, Streptococcus pneumoniae
MEFSKKTRELSIKKMQERTLDLLIIGGGITGAGVALQAAASGLETGLIEMQDFAEGTSSRSTKLVHGGLRYLKQFDVEVVSDTVSERAVVQQIAPHIPKSDPMLLPVYDEDGATFSLFRLKVAMDLYDLLAGVSNTPAANKVLSKDQVLERQPNLKKEGLVGGGVYLDFRNNDARLVIENIKRANQDGALIANHVKAEGFLFDESGKITGVVARDLLTDQVFEIKARLVINTTGPWSDKVRNLSNKGTQFSQMRPTKGVHLVVDSSKIKVSQPVYFDTGLGDGRMVFVLPRENKTYFGTTDTDYTGDLEHPKVTQEDVDYLLGIVNNRFPESNITIDDIESSWAGLRPLIAGNSASDYNGGNNGTISDESFDNLIATVESYLSKEKTREDVESAVSKLESSTSEKHLDPSAVSRGSSLDRDDNGLLTLAGGKITDYRKMAEGAMERVVDILKAEFDRSFKLINSKTYPVSGGELNPANVDSEIEAFAQLGVSRGLDSKEAHYLANLYGSNAPKVFALAHSLEQAPGLSLADTLSLHYAMRNELTLSPVDFLLRRTNHMLFMRDSLDSIVEPILDEMGRFYDWTEEEKATYRADVEAALANNDLAELKN

SEQ ID NO: 9 - protein, 234 aa, Streptococcus pneumoniae
MMNELFGEFLGTLILILLGNGVVAGVVLPKTKSNSSGWIVITMGWGIAVAVAVFVSGKLSPAYLNPAVTIGVALKGGLPWASVLPYILAQFAGAMLGQILVWLQFKPHYEAEENAGNILATFSTGPAIKDTVSNLISEILGTFVLVLTIFALGLYDFQAGIGTFAVGTLIVGIGLSLGGTTGYALNPARDLGPRIMHSILPIPNKGDGDWSYAWIPVVGPVIGAALAVLVFSLF

SEQ ID NO: 10 - protein, 136 aa, Streptococcus pneumoniae
MTKKKIERISVIHREKILWLKWYFMRDKEQPKYSVLERKMFDAAKNQDMLAYQKYATIKQITDIRVQTSEADILEAVKEVYVYNHMNVIGACQRILFISQSPAYDKLNKWFNIYSDLYFSVVPLPKMGVYHEMVGI

SEQ ID NO: 11 - protein, 1099 aa, Streptococcus pneumoniae
MKNSNEAEMKLLYTDIRTSLTEILTREAEELVAAGKRVFYIAPNSLSFEKERAVLEYLSQQASFSITVTRFAQMARYLVLNDLPAKTTLDDIGLGLAFYKCLAELDPKDLRVYGAIKQDPQLIQQLIELYHEMTKSQMSFLDLENLTDEDKRADLLLIFEKVTAYLNQGQLAQESQLSHLIEAIENDKVSSDFNQIALVIDGFTRFSAEEERVVDLLHGKGVEIVIGAYASKKAYTSPFSEGNLYQASVKFLHHLASKYQTPAQDCSQTHEKMDSFDKASRLLESSYDFSELALDVDEKDRENLQIWSCLTQKEELELVARSIRQKLHENSDLSYKHFRILLGDVASYQLSLKTIFDQYQIPFYLGRSEAMAHHPLTQFVESILALKRYRFRQEDLINLLRTDLYTDLSQSDIDAFEQYIRYLGINGLPAFQQTFTKSHHGKFNLERLNVLRLRILAPLETLFASRKQKAEKLLQKWSVFLKEGAVTKQLQDLTTTLEAVEQERQAEVWKAFCHVLEQFATVFAGSQVSLEDFLALLHSGMSLSQYRTIPATVDTVLVQSYDLIAPLTADFVYAIGLTQDNLPKISQNTSLLTDEERQNLNQATEEGVQLLIASSENLKKNRYTMLSLVNSARKQLFLSAPSLFNESESKESAYLQELIHFGFRRREKRMNHKGLSKEDMGSYHSLLSSLVAYHQQGEMSDTEQDLTFVKVLSRVIGKKLDQQGLENPAIPTSPSSKTLAKDTLQALYPAKQEFYLSTSGLTEFYRNEYSYFLRYVLGLQEELRLHPDARSHGNFLHRIFERALQLPNEDSFDQRLEQAIQETSQEREFEAIYQESLEAQFTKEVLLDVARTTGHILRHNPAIETIKEEANFGGKDQAFIQLDNGRSVFVRGKVDRIDRLKANGAIGVVDYKSSLTQFQFPHFFNGLNSQLPTYLAALKREGEQNFFGAMYLEMAEPVQSLMAVKSLAGAVVEASKSMKYQGLFLEKESSYLGEFYNKNKANQLTDEEFQLLLDYNAYLYKKAAEKILAGRFAINPYTENGRSIAPYVQQHQAITGFEANYHLGQARFLEKLDLADGKRLVGEKLKQAWLEKIREELNR

SEQ ID NO: 12 - protein, 1216 aa, Streptococcus pneumoniae
MKLIPFLSEEEIQKLQEAEANSSKEQKKTAEQIEAIYTSAQNILVSASAGSGKTFVMAERILDQLARGVEISQLFISTFTVKAATELKERLEKKISKKIQETDDVDLKQHLGRQLADLPNAAIGTMDSFTQKFLGKHGYLLDIAPNFRILQNQSEQLILENEVFHEVFEAHYQGKQKETFSHLLKNFAGRGKDERGLRQQVYKIYDFLQSTSNPQKWLSESFLKGFEKADFTSEKEKLTEQIKQALWDLESFFRYHLDNDAKEFAKAAYLENVQLILDEIGSLNQESDSQAYQAVLARVVAISKEKNGRALTNASRKADLKPLADAYNEERKTQFAKLGQLSDQIAILDYQERYHGDTWKLAKTFQSFMSDFVEAYRQRKRQENAFEFADISHYTIEILENFPQVRESYQERFHEVMVDEYQDTNHIQERMLELLSNGHNRFMVGDIKQSIYRFRQADPQIFNEKFQRYAQNPQEGRLIILKENFRSSSEVLSATNDVFERLMDQEVGEINYDNKHQLVFANTKLTPNPDNKAAFLLYDKDDTGEEEESQTETKLTGEMRLVIKEILKLHQEKGVAFKEIALLTSSRSRNDQILLALSEYGIPVKTDGEQNNYLQSLEVQVMLDTLRVIHNPLQDYALVALMKSPMFGFDEDELARLSLQKAEDKVHENLYEKLVNAQKMASSQKGLIHTALAEKLKQFMDILASWRLYAKTHSLYDLIWKIYNDRFYYDYVGALPNGPARQANLYALALRADQFEKSNFKGLSRFIRMIDQVLEAQHDLASVAVAPPKDAVELMTIHKSKGLEFPYVFILNMDQDFNKQDSMSEVILSRQNGLGVKYIAKMETGAVEDHYPKTIKLSIPSLTYRQNEEELQLASYSEQMRLLYVAMTRAEKKLYLVGKGSREKLESKEYPAAKNGKLNSNTRLQARNFQDWLWAISKVFTKDKLNFSYRFIGEDQLTREAIGELETKSPLQDSSQADNRQSDTIKEALEMLKEVEVYNTLHRAAIELPSVQTPSQIKKFYEPVMDMEGVEIAGQGQSVGKKISFDLPDFSTKEKVTGAEIGSATHELMQRIDLSQQLTLASLTETLKQVQTSQAVRDKINLDKILAFFDTVLGQEILANTDHLYREQPFSMLKRDQKSQEDFVVRGILDGYLLYENKIVLFDYKTDRYDEPSQLVDRYRGQLALYEEALSRAYSIENIEKYLILLGKDEVQVVKV

SEQ ID NO: 13 - protein, 215 aa, Streptococcus pneumoniae
MELARHAESLGVDAIATIPPIYFRLPEYSVAKYWNDISSAAPNTDYVIYNIPQLAGVALTPSLYTEMLKNPRVIGVKNSSMPVQDIQTFVSLGGEDHIVFNGPDEQFLGGRLMGARAGIGGTYGAMPELFLKLNQLIADKDLETARELQYAINAIIGKLTSAHGNMYGVIKEVLKINEGLNIGSVRSPLTPVTEEDRPVVEAAAALIRETKERFL

SEQ ID NO: 14 - protein, 407 aa, Streptococcus pneumoniae
MYKTKCLREKLVLFLKIFFPILIYQFANYSASFVDTAMTGQYNTMDLAGVSMATSIWNPFFTFLTGIVSALVPIIGHHLGRGKKEEVASDFYQFIYLALGLSVVLLGMVLFLAPIILNHIGLEAAVAAVAVRYLWFLSIGIIPLLLFSVIRSLLDSLGLTKLSMYLMLLLLPLNSGFNYLLIYGAFGVPELGGAGAGLGTSLAYWVLLGISVLVLFKQEKLKALHLEKRIPLNMDKIKEGVRLGLPIGGTVFAEVAIFSVVGLIMAKFSPLIIASHQSAMNFSSLMYAFPMSISSAMAIVVSYEVGAKRFDDAKTYIGLGRWTALIFAAFTLTFLYIFRGNVASLYGNDPKFIDLTVRFLTYSLFFQLADTFAAPLQGILRGYKDTVIPFYLGLLGYWGVAIPVYAI

SEQ ID NO: 15 - protein, 189 aa, Streptococcus pneumoniae
MSTLAKIEALLFVAGEDGIRVRQLAELLSLPPTGIQQSLGKLAQKYEKDPDSSLALIETSGAYRLVTKPQFAEILKEYSKAPINQSLSRAALETLSIIAYKQPITRIEIDAIRGVNSSGALAKLQAFDLIKEDGKKEVLGRPNLYVTTDYFLDYMGINHLEELPVIDELEIQAQESQLFGERIEEDENQ

SEQ ID NO: 16 - protein, 311 aa, Streptococcus pneumoniae
MDTMISRFFRHLFEALKSLKRNGWMTVAAVSSVMITLTLVAIFASVIFNTAKLATDIENNVRVVVYIRKDVEDNSQTIEKEGQTVTNNDYHKVYDSLKNMSTVKSVTFSSKEEQYEKLTEIMGDNWKIFEGDANPLYDAYIVEANTPNDVKTIAEDAKKIEGVSEVQDGGANTERLFKLASFIRVWGLGIAALLIFIAVFLISNTIRITIISRSREIQIMRLVGAKNSYIRGPFLLEGAFIGLLGAIAPSVLVFIVYQIVYQSVNKSLVGQNLSMISPDLFSPLMIALLFVIGVFIGSLGSGISMRRFLKI

SEQ ID NO: 17 - protein, 658 aa, Streptococcus pneumoniae
MKKVRFIFLALLFFLASPEGAMASDGTWQGKQYLKEDGSQAANEWVFDTHYQSWFYIKADANYAENEWLKQGDDYFYLKSGGYMAKSEWVEDKGAFYYLDQDGKMKRNAWVGTSYVGATGAKVIEDWVYDSQYDAWFYIKADGQHAEKEWLQIKGKDYYFKSGGYLLTSQWINQAYVNASGAKVQQGWLFDKQYQSWFYIKENGNYADKEWIFENGHYYYLKSGGYMAANEWIWDKESWFYLKFDGKMAEKEWVYDSHSQAWYYFKSGGYMTANEWIWDKESWFYLKSDGKIAEKEWVYDSHSQAWYYFKSGGYMTANEWIWDKESWFYLKSDGKIAEKEWVYDSHSQAWYYFKSGGYMAKNETVDGYQLGSDGKWLGGKTTNENAAYYQVVPVTANVYDSDGEKLSYISQGSVVWLDKDRKSDDKRLAITISGLSGYMKTEDLQALDASKDFIPYYESDGHRFYHYVAQNASIPVASHLSDMEVGKKYYSADGLHFDGFKLENPFLFKDLTEATNYSAEELDKVFSLLNINNSLLENKGATFKEAEEHYHINALYLLAHSALESNWGRSKIAKDKNNFFGITAYDTTPYLSAKTFDDVDKGILGATKWIKENYIDRGRTFLGNKASGMNVEYASDPYWGEKIASVMMKINEKLGGKD

SEQ ID NO: 18 - protein, 288 aa, Streptococcus pneumoniae
MKKVLQKYWAWAFVVIPLLLQAIFFYVPMFQGAFYSFTNWTGLTYNYKFVGLNNFKLLFMDPKFMNAIGFTAIIAIAMVVGEIALGIFIARVLNSKIKGQTFFRAWFFFPAVLSGLTVALIFKQVFNYGLPAIGNALHIEFFQTSLLGTKWGAIFAAVFVLLWQGVAMPIIIFLAGLQSIPTEITEAARIDGATSKQVFWNIELPYLLPSVSMVFILALKGGLTAFDQVFAMTGGGPNNATTSLGLLVYNYAFKNNQFGYANAIAVILFFLIVVISIIQLRVSKKFEI

SEQ ID NO: 19 - protein, 278 aa, Streptococcus pneumoniae
MMKQDERKALIGKYILLILGSVLILVPLLATLFSSFKPTKDIVDNFFGFPTNFTWDNFSRLLADGIGGYYWNSVVITVLSLLAVMIFIPMAAYSIARNMSKRKAFTIMYTLLILGIFVPFQVIMIPITVMMSKLGLANTFGLILLYLTYAIPQTLFLYVGYIKISIPESLDEAAEIDGANQFTTYFRIIFPMMKPMHATTMIINALWFWNDFMLPLLVLNRDSKMWTLPLFQYNYAGQYFNDYGPSFASYVVGIISITIVYLFFQRHIISGMSNGAVK

SEQ ID NO: 20 - protein, 347 aa, Streptococcus pneumoniae
MKSILQKMGEHPMLLLFLSYSTVISILAQNWMGLVASVGMFLFTIFFLHYQSILSHKFFRLILQFVLFGSVLSAAFASLEHFQIVKKFNYAFLSPNMQVWHQNRAEVTFFNPNYYGIICCFCIMIAFYLFTTTKLNWLKVFCVIAGFVNLFGLNFTQNRTAFPAIIAGAIIYLFTTIKNWKAFWLSIGVFAIGLSFLFSSDLGVRMGTLDSSMEERISIWDAGMALFKQNPFWGEGPLTYMNSYPRIHAPYHEHAHSLYIDTILSYGIVGTILLVLSSVAPVRLMMDMSQESGKRPIIGLYLSFLTVVAVHGIFDLALFWIQSGFIFLLVMCSIPLEHRMLVSDMTD

SEQ ID NO: 21 - protein, 432 aa, Streptococcus pneumoniae
MSKMDVQKIIAPMMKFVNMRGIIALKDGMLAILPLTVVGSLFLIMGQLPFEGLNKSIASVFGANWTEPFMQVYSGTFAIMGLISCFSIAYSYAKNSGVEALPAGVLSVSAFFILLRSSYIPKQGEAIGDAISKVWFGGQGIIGAIIIGLVVGSIYTFFIKRKIVIKMPEQVPQAIAKQFEAMIPAFVIFLSSMIVYILAKSLTNGGTFIEMIYSAIQVPLQGLTGSLYGAIGIAFFISFLWWFGVHGQSVVNGVVTALLLSNLDANKAMLASANLSLENGAHIVTQQFLDSFLILSGSGITFGLVVAMLFAAKSKQYQALGKVAAFPAIFNVNEPVVFGFPIVMNPVMFVPFILVPVLAAVIVYGAIATGFMQPFSGVTLPWSTPAILSGFLVGGWQGVITQLVILAMSTLVYFPFFKVQDRLAYQNEIKQS

SEQ ID NO: 22 - protein, 100 aa, Streptococcus pneumoniae
MKKKDLVDQLVSEIETGKVRTLGIYGHGASGKSTFAQELYQALDSTTVNLLETDPYITSGRHLVVPKDAPNQKVTASLPVAHELESLQRDILACRRVWMS

SEQ ID NO: 23 - protein, 238 aa, Streptococcus pneumoniae
MKKRYLVLTALLALSLAACSQEKTKNEDGETKTEQTAKADGTVGSKSQGAAQKKAEVVNKGDYYSIQGKYDEIIVANKHYPLSKDYNPGENPTAKAELVKLIKAMQEAGFPISDHYSGFRSYETQTKLYQDYVNQDGKAAADRYSARPGYSEHQTGLAFDVIGTDGDLVTEEKAAQWLLDHAADYGFVVRYLKGKEKETGYMAEEWHLRYVGKEAKEIAASGLSLEEYYGFEGGDYVD

SEQ ID NO: 24 - protein, 425 aa, Streptococcus pneumoniae
MREPDFLNHFLKKGYFKKHAKAVLALSGGLDSMFLFKVLSTYQKELEIELILAHVNHKQRIESDWEEKELRKLAAEAELPIYISNFSGEFSEARARNFRYDFFQEVMKKTGATALVTAHHADDQVETIFMRLIRGTRLRYLSGIKEKQVVGEIEIIRPFLHFQKKDFPSIFHFEDTSNQENHYFRNRIRNSYLPELEKENPRFRDAILGIGNEILDYDLAIAELSNNINVEDLQQLFSYSESTQRVLLQTYLNRFPDLNLTKAQFAEVQQILKSKSQYRHPIKNGYELIKEYQQFQICKISPQADEKEDELVLHYQNQVAYQGYLFSFGLPLEGELIQQIPVSRETSIHIRHRKTGDVLIKNGHRKKLRRLFIDLKIPMEKRNSALIIEQFGEIVSILGIATNNLSKKTKNDIMNTVLYIEKIDR

SEQ ID NO: 25 - protein, 422 aa, Streptococcus pneumoniae
MRKFLIILLLPSFLTISKVVSTEKEVVYTSKEIYYLSQSDFGIYFREKLSSPMVYGEVPVYANEDLVVESGKLTPKTSFQITEWRLNKQGIPVFKLSNHQFIAADKRFLYDQSEVTPTIKKVWLESDFKLYNSPYDLKEVKSSLSAYSQVSIDKTMFVEGREFLHIDQAGWVAKESTSEEDNRMSKVQEMLSEKYQKDSFSIYVKQLTTGKEAGINQDEKMYAASVLKLSYLYYTQEKINEGLYQLDTTVKYVSAVNDFPGSYKPEGSGSLPKKEDNKEYSLKDLITKVSKESDNVAHNLLGYYISNQSDATFKSKMSAIMGDDWDPKEKLISSKMAGKFMEAIYNQNGFVLESLTKTDFDSQRIAKGVSVKVAHKIGDADEFKHDTGVVYADSPFILSIFTKNSDYDTISKIAKDVYEVLK

SEQ ID NO: 26 - protein, 652 aa, Streptococcus pneumoniae
MKKQNNGLIKNPFLWLLFIFFLVTGFQYFYSGNNSGGSQQINYTELVQEITDGNVKELTYQPNGSVIEVSGVYKNPKTSKEETGIQFFTPSVTKVEKFTSTILPADTTVSELQKLATDHKAEVTVKHESSSGIWINLLVSIVPFGILFFFLFSMMGNMGGGNGRNPMSFGRSKAKAANKEDIKVRFSDVAGAEEEKQELVEVVEFLKDPKRFTKLGARIPAGVLLEGPPGTGKTLLAKAVAGEAGVPFFSISGSDFVEMFVGVGASRVRSLFEDAKKAAPAIIFIDEIDAVGRQRGVGLGGGNDEREQTLNQLLIEMDGFEGNEGIIVIAATNRSDVLDPALLRPGRFDRKVLVGRPDVKGREAILKVHAKNKPLAEDVDLKLVAQQTPGFVGADLENVLNEAALVAARRNKSIIDASDIDEAEDRVIAGPSKKDKTVSQKERELVAYHEAGHTIVGLVLSNARVVHKVTIVPRGRAGGYMIALPKEDQMLLSKEDMKEQLAGLMGGRVAEEIIFNVQTTGASNDFEQATQMARAMVTEYGMSEKLGPVQYEGNHAMLGAQSPQKSISEQTAYEIDEEVRSLLNEARNKAAEIIQSNRETHKLIAEALLKYETLDSTQIKALYETGKMPEAVEEESHALSYDEVKSKMNDEK

SEQ ID NO: 27 - protein, 563 aa, Streptococcus pneumoniae
MKRSSLLVRMVISIFLVFLILLALVGTFYYQSSSSAIEATIEGNSQTTISQTSHFIQSYIKKLETTSTGLTQQTDVLAYAENPSQDKVEGIRDLFLTILKSDKDLKTVVLVTKSGQVISTDDSVQMKTSSDMMAEDWYQKAIHQGAMPVLTPARKSDSQWVISVTQELVDAKGANLGVLRLDISYETLEAYLNQLQLGQQGFAFIINENHEFVYHPQHTVYSSSSKMEAMKPYIDTGQGYTPGHKSYVSQEKIAGTDWTVLGVSSLEKLDQVRSQLLWTLLGASVTSLLVCLCLVWFSLKRWIAPLKDLRETMLEIASGAQNLRAKEVGAYELREVTRQFNAMLDQIDQLMVAIRSQEETTRQYQLQALSSQINPHFLYNTLDTIIWMAEFHDSQRVVQVTKSLATYFRLALNQGKDLICLSDEINHVRQYLFIQKQRYGDKLEYEINENVAFDNLVLPKLVLQPLVENALYHGIKEKEGQGHIKLSVQKQDSGLVIRIEDDGVGFQDAGDSSQSQLKRGGVGLQNVDQRLKLHFGANYHMKIDSRPQKGTKVEIYINRIETS

SEQ ID NO: 28 - protein, 563 aa, Streptococcus pneumoniae; identical to SEQ ID NO: 27

SEQ ID NO: 29 - protein, 379 aa, Streptococcus pneumoniae
MFFKLLREALKVKQVRSKILFTIFIVLVFRIGTSITVPGVNANSLNALSGLSFLNMLSLVSGNALKNFSIFALGVSPYITASIVVQLLQMDILPKFVEWGKQGEVGRRKLNQATRYIALVLAFVQSIGITAGFNTLAGAQLIKTALTPQVFLTIGIILTAGSMIVTWLGEQITDKGYGNGVSMIIFAGIVSSIPEMIQGIYVDYFVNVPSSRITSSIIFVIILIITVLLIIYFTTYVQQAEYKIPIQYTKVAQGAPSSSYLPLKVNPAGVIPVIFASSITAAPAAILQFLSATGHDWAWVRVAQEMLATTSPTGIAMYALLIILFTFFYTFVQINPEKAAETYKRVVPISMEFVLVKVQKNICLNFFVVLQLLVPSSLV

SEQ ID NO: 30 - protein, 445 aa, Streptococcus pneumoniae
MDIRQVTETIAMIEEQNFDIRTITMGISLLDCIDPDINRAAEKIYQKITTKAANLVAVGDEIAAELGIPIVNKRVSVTPISLIGAATDATDYVVLAKALDKAAKEIGVDFIGGFSALVQKGYQKGDEILINSIPRALAETDKVCSSVNIGSTKSGINMTAVADMGRIIKETANLSDMGVAKLVVFANAVEDNPFMAGAFHGVGEADVIINVGVSGPGVVKRALEKVRGQSFDVVAETVKKTAFKITRIGQLVGQMASERLGVEFGIVDLSLAPTPAVGDSVARVLEEMGLETVGTHGTTAALALLNDQVKKGGVMACNQVGGLSGAFIPVSEDEGMIAAVQNGSLNLEKLEAMTAICSVGLDMIAIPEDTPAETIAAMIADEAAIGVINMKTTAVRIIPKGKEGDMIEFGGLLGTAPVMKVNGASSVDFISRGGQIPAPIHSFKN

SEQ ID NO: 31 - protein, 285 aa, Streptococcus pneumoniae
MTQIIDGKALAAKLQGQLAEKTAKLKEETGLVPGLVVILVGDNPASQVYVRNKERSALAAGFRSEVVRVPETITQEELLDLIAKYNQDPAWHGILVQLPLPKHIDEEAVLLAIDPEKDVDGFHPLNMGRLWSGHPVMIPSTPAGIMEMFHEYGIDLEGKNAVVIGRSNIVGKPMAQLLLAKNATVTLTHSRTHNLSKVAAKADILVVAIGRAKFVTADFVKPGAVVIDVGMNRDENGKLCGDVDYEAVAPLASHITPVPGGVGPMTITMLMEQTYQAALRTLDRK

SEQ ID NO: 32 - protein, 403 aa, Streptococcus pneumoniae
MSKFNRIHLVVLDSVGIGAAPDANNFVNAGVPDGASDTLGHISKTVGLNVPNMAKIGLGNIPRETPLKTVAAESNPTGYATKLEEVSLGKDTMTGHWEIMGLNITEPFDTFWNGFPEEILTKIEEFSGRKVIREANKPYSGTAVIYDFGPRQMETGELIIYTSADPVLQIAAHEDIIPLDELYRICEYARSITLERPALLGRIIARPYVGEPGNFTRTANRRDLAVSPFFPTVLDKLNEAGIDTYAVGKINDIFNGAGINHDMGHNKSNSHGIDTLLKTMGLAEFEKGFSFTNLVDFDALYGHRRNAHGYRDCLHEFDERLPEIIAAMRENDLLLITADHGNDPTYAGTDHTREYIPLLAYSPAFKGNGLIPVGHFADISATVADNFGVETAMIGESFLDKLV

SEQ ID NO: 33 - protein, 326 aa, Streptococcus pneumoniae
MFISISAGIVTFLLTLVEIPAFIQFYRKAQITGQQMHEDVKQHQAKAGTPTMGGLVFLITSVLVAFFFALFSSQFSNNVGMILFILVLYGLVGFLDDFLKVFRKINEGLNPKQKLALQLLGGVIFYLFYERGGDILSVFGYPVHLGFFYIFFALFWLVGFSNAVNLTDGVDGLASISVVISLSAYGVIAYVQGQMDILLVILAMIGGLLGFFIFNHKPAKVFMGDVGSLALGGMLAAISMALHQEWTLLIIGIVYVFETTSVMMQVSYFKLTGGKRIFRMTPVHHHFELGGLSGKGNPWSEWKVDFFFWGVGLLASLLTLAILYLM

SEQ ID NO: 34 - protein, 426 aa, Streptococcus pneumoniae
LFKKNKDILNIALPAMGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 35 - protein, 420 aa, Streptococcus pneumoniae
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVASLLAIVLNAVLNHKKK

SEQ ID NO: 36 - protein, 784 aa, Streptococcus pneumoniae
MKDRIKEYLQDKGKVTVNDLAQALGKDSSKDFRELIKTLSLMERKHQIRFEEDGSLTLEIKKKHEITLKGIFHAHKNGFGFVSLEGEEDDLFVGKNDVNYAIDGDTVEVVIKKVADRNKGTAAEAKIIDILEHSLTTVVGQIVLDQEKPKYAGYIRSKNQKISQPIYVKKPALKLEGTEVLKVFIDKYPSKKHDFFVASVLDVVGHSTDVGIDVLEVLESMDIVSEFPEAVVKEAESVPDAPSQKDMEGRLDLRDEITFTIDGADAKDLDDAVHIKALKNGNLEFGVHIADVSYYVTEGSALDKEALNRATSVYVTDRVVPMLPERLSNGICSLNPQVDRLTQSAIMEIDKHGRVVNYTITQTVIKTSFRMTYSDVNDILAGDEEKRKEYHKIVSSIELMAKLHETLENMRVKRGALNFDTNEAKILVDKQGKPVDIVLRQRGIAERMIESFMLMANETVAEHFSKLDLPFIYRIHEEPKAEKVQKFIDYASSFGLRIYGTASEISQEALQDIMRAVEGEPYADVLSMMLLRSMQQARYSEHNHGHYGLAADYYTHFTSPIRRYPDLLVHRMIRDYGRSKEIAEHFEQVIPEIATQSSNRERRAIEAEREVEAMKKAEYMEEYVGEEYDAVVSSIVKFGLFVELPNTVEGLIHITNLPEFYHFNERDLTLRGEKSGITFRVGQQIRIRVERADKMTGEIDFSFVPSEFDVIEKGLKQSSRSGRGRDSNRRSDKKEDKRKSGRSNDKRKHSQKDKKKKGKKPFYKEVAKKGAKHGKGRGKGRRTK

SEQ ID NO: 37 - protein, 513 aa, Streptococcus pneumoniae
MGTTGFTIIDLIILIVYLLAVLVAGIYFSKKEMKGKEFFKGDGSVPWYVTSVSIFATMLSPISFLGLAGSSYAGSWILWFAQLGMVVAIPLTIRFILPIFARIDIDTAYDYLDKRFNSKALRIISALLFIIYQLGRMSIIMYLPSAGLSVLTGIDINILIILMGVVAIVYSYTGGLKSVLWTDFIQGVILISGVVLALFVLIANIKGGFGAVAETLANGKFLAANEKLFDPNLLSNSIFLIVMGSGFTILSSYASSQDLVQRFTTTQNIKKLNKMLFTNGVLSLATATVFYLIGTGLYVFYQVQNADSAASNIPQDQIFMYFIAYQLPVGITGLILAAIYAASQSTISTGLNSVATSWTLDIQDVISKNMSDNRRTKIAQFVSLAVGLFSIGVSIVMAHSDIKSAYEWFNSFMGLVLGLLGGVFILGFVSKKANKQGAYAALIVSTIVMVFIKYFLPPTAVSYWAYSLISISVSVVSGYIVSVLTGNKVSAPKYTTIHDITEIKADSSWEVRH

SEQ ID NO: 38 - protein, 484 aa, Streptococcus pneumoniae
MKFSKKYIAAGSAVIVSLSLCAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKVRKNI

SEQ ID NO: 39 - protein, 153 aa, Streptococcus pneumoniae
MKKRAIVAVIVLLLIGLDQLVKSYIVQQIPLGEVRSWIPNFVSLTYLQNRGAAFSILQDQQLLFAVITLVVVIGAIWYLHKHMEDSFWMVLGLTLIIAGGLGNFIDRVSQGFVVDMFHLDFINFAIFNVADSYLTVGVIILLIAMLKEEINGN

SEQ ID NO: 40 - protein, 284 aa, Streptococcus pneumoniae
MNTNLASFIVGLIIDENDRFYFVQKDGQTYALAKEEGQHTVGDTVKGFAYTDMKQKLRLTTLEVTATQDQFGWGRVTEVRKDLGVFVDTGLPDKEIVVSLDILPELKELWPKKGDQLYIRLEVDKKDRIWGLLAYQEDFQRLARPAYNNMQNQNWPAIVYRLKLSGTFVYLPENNMLGFIHPSERYAEPRLGQVLDARVIGFREVDRTLNLSLKPRSFEMLENDAQMILTYLESNGGFMTLNDKSSPDDIKATFGISKGQFKKALGGLMKAGKIKQDQFGTELI

SEQ ID NO: 41 - protein, 394 aa, Streptococcus pneumoniae
MKDVSLFLLKKVFKSRLNWIVLALFVSVLGVTFYLNSQTANSHSLESRLESRIAANERAINENEEKLSQMSDTSSEEYQFAKNNLDVQKNLLTRKTEILTLLKEGRWKEAYYLQWQDEEKNYEFVSNDPTASPGLKMGVDRERKIYQALYPLNIKAHTLEFPTHGIDQIVWILEVIIPSLFVVAIIFMLTQLFAERYQNHLDTAHLYPVSKVTFAISSLGVGVGYVTVLFIGICGFSFLVGSLISGFGQLDYPYPIYSLVNQEVTIGKIQDVLFPGLLLAFLAFIVIVEVVYLIAYFFKQKMPVLFLSLIGIVGLLFGIQTIQPLQRIAHLIPFTYLRSVEILSGRLPKQIDNVDLNWSMGMVLLPCLIIFLLLGILFIERWGSSQKKEFFNRF

SEQ ID NO: 42 - protein, 448 aa, Streptococcus pneumoniae
MMKFILDIVSTPAILVALIAILGLVLQKKKLPDIIKGGIKTFVGFLVVSGGAGIVQNSLNPFGTMFEHAFHLSGVVPNNEAIVAVALTTYGSATAMIMFAGMVFNILIARFTRFKYIFLTGHHTLYMACMIAVILSVAGFTSLPLILLGGLALGIIMSISPAFVQKYMVQLTGNDKVALGHFSSLGYWLSGFTGSLIGDKSKSTEDIKFPKSLAFLRDSTVSITLSMAVIYIIVAIFAGSEYIEKEISSGTSGLVYALQLAGQFAAGVFVILAGVRLILGEIVPAFKGISERLVPNSKPALDCPIVYTYAPNAVLIGFISSFVGGLVSMVIMIASGTVVILPGVVPHFFCGATAGVIGNASGGVRGATIGAFLQGILISFLPVFLMPVLGGLGFQGSTFSDADFGLSGIILGMLNQFGSQAGIVIGLVLILAVMFGVSFIKKPSATEE

SEQ ID NO: 43 - protein, 333 aa, Streptococcus pneumoniae
MIKTFLSALSVILFSIPIITYSFFPSSNLNIWLSTQPILAQIYAFPLATATMAAILSFLFFFLSFYKKNKQIRFYSGILLLLSLILLLFGTDKTLSSASNKTKTLKLVTWNVANQIEAQHIERIFSHFDADMAIFPELATNIRGEQENQRIKLLFHQVGLSMANYDIFTSPPTNSGIAPVTVIVKKSYGFYTEAKTFHTTRFGTIVLHSRKQNIPDIIALHTAPPLPGLMEIWKQDLNIIHNQLASKYPKAIIAGDFNATMRHGALAKISSHRDALNALPPFERGTWNSQSPKLFNATIDHILLPKNHYYVKDLDIVSFQNSDHRCIFTEITF

SEQ ID NO: 44 - protein, 425 aa, Streptococcus pneumoniae
MNPIQRSWAYVSRKRLRSFILFLILLVLLAGISACLTLMKSNKTVESNLYKSLNTSFSIKKIENGQTFKLSDLASVSKIKGLENVSPELETVAKLKDKEAVTGEQSVERDDLSAADNNLVSLTALEDSSKDVTFTSSAFNLKEGRHLQKGDSKKILIHEELAKKNGLSLHDKIGLDAGQSESGKGQTVEFEIIGIFSGKKQEKFTGLSSDFSENQVFTDYESSQTLLGNSEAQVSAARFYVENPKEMDGLMKQVENLALENQGYQVEKENKAFEQIKDSVATFQTFLTIFLYGMLIAGAGALILVLSLWLRERVYEVGILLALGKGKSSIFLQFCLEVVLVSLGALLPAFVAGNAITTYLLQTLLASGDQASLQDTLAKASSLSTSILSFAESYVFLVLLSCLSVALCFLFLFRKSPKEILSSIS

SEQ ID NO: 45 - protein, 459 aa, Streptococcus pneumoniae
MLHNAFAYVTRKFFKSIVIFLIILLMASLSLVGLSIKGATAKASQETFKNITNSFSMQINRRVNQGTPRGAGNIKGEDIKKITENKAIESYVKRINAIGDLTGYDLIETPETKKNLTADRAKRFGSSLMITGVNDSSKEDKFVSGSYKLVEGEHLTNDDKDKILLHKDLAAKHGWKVGDKVKLDSNIYDADNEKGAKETVEVTIKGLFDGHNKSAVTYSQELYENTAITDIHTAAKLYGYTEDTAIYGDATFFVTADKNLDDVMKELNGISGINWKSYTLVKSSSNYPALEQSISGMYKMANLLFWGSLSFSVLLLALLLSLWINARRKEVGILLSIGLKQASILGQFITESILIAIPALVSAYFLANYTARAIGNTVLANVTSGVAKQASKAAQASNLGGGAEVDGFSKTLSSLDISIQTSDFIIIFVLALVLVVLVMALASSNLLRKQPKELLLDGE

SEQ ID NO: 46 - protein, 205 aa, Streptococcus pneumoniae
MSQDKQMKAVSPLLQRVINISSIVGGVGSLIFCIWAYQAGILQSKETLSAFIQQAGIWGPPLFIFLQILQTVVPIIPGALTSVAGVFIYGHIIGTIYNYIGIVIGCAIIFYLVRLYGAAFVQSVVSKRTYDKYIDWLDKGNRFDRFFIFMMIWPISPADFLCMLAALTKMSFKRYMTIIILTKPFTLVVYTYGLTYIIDFFWQML

SEQ ID NO: 47 - protein, 399 aa, Streptococcus pneumoniae
MRNMWVVIKETYLRHVESWSFFFMVISPFLFLGISVGIGHLQGSSMAKNNKVAVVTTVPSVAEGLKNVNGVNFDYKDEASAKEAIKEEKLKGYLTIDQEDSVLKAVYHGETSLENGIKFEVTGTLNELQNQLNRSTASLSQEQEKRLAQTIQFTEKIDEAKENKKFIQTIAAGALGFFLYMILITYAGVTAQEVASEKGTKIMEVVFSSIRASHYFYARMMALFLVILTHIGIYVVGGLAAVLLFKDLPFLAQSGILDHLGDAISLNTLLFILISLFMYVVLAAFLGSMVSRPEDSGKALSPLMILIMGGFFGVTALGAAGDNLLLKIGSYIPFISTFFMPFRTINDYAGGAEAWISLAITVIFAVVATGFIGRMYASLVLQTDDLGIWKTFKRALSYK

SEQ ID NO: 48 - protein, 438 aa, Streptococcus pneumoniae
MTETIKLMKAHTSVRRFKEQEIPQVDLNEILTAAQMASSWKNFQSYSVIVVRSQEKKDALYELVPQEAIRQSAVFLLFVGDLNRAEKGARLHTDTFQPQGVEGLLISSVDAALAGQNALLAAESLGYGGVIIGLVRYKSEEVAELFNLPDYTYSVFGMALGVPNQHHDMKPRLPLENVVFEEEYQEQSTEAIQAYDRVQADYAGARATTSWSQRLAEQFGQAEPSSTRKNLEQKKLLMLKLIAIVGTNSKRSTNRQLLQYMQKHFTDKAEIELVEIKAIPVFNKPADKQVPAEILEIAAKIEEADGVIIGTPEYDHSIPAVLMSALAWLSYGIYPLLNKPIMITGASYGTLGSSRAQLQLRQILNAPEIKANVLPDEFLLSHSLQAFNPSGDLVDLDVIKKLDAIFDDFRIFVKITEKLRNAQELLRKDAEDFDWENL

SEQ ID NO: 49 - protein, 280 aa, Streptococcus pneumoniae
MNTYQLNNGVEIPVLGFGTFKAKDGEEAYRAVLEALKAGYRHIDTAAIYQNEESVGQAIKDSGVPREEMFVTTKLWNSQQTYEQTRQALEKSIEKLGLDYLDLYLIHWPNPKPLRENDAWKTRNAEVWRAMEDLYQEGKIRAIGVSNFLPHHLDALLETATIVPAVNQVRLAPGVYQDQVVAYCREKGILLEAWGPFGQGELFDSKQVQEIAANHGKSVAQIALAWSLAEGFLPLPKSVTTSRIQANLDCFGIELSHEERETLKTIAVQSGAPRVDDVDF

SEQ ID NO: 50 - protein, 266 aa, Streptococcus pneumoniae
MRCKMLDPIAIQLGPLAIRWYALCIVTGLILAVYLTMKEAPRKKIIPDDILDFILVAFPLAILGARLYYVIFRFDYYSQNLGEIFAIWNGGLAIYGGLITGALVLYIFADRKLINTWDFLDIAAPSVMIAQSLGRWGNFFNQEAYGATVDNLDYLPGFIRDQMYIEGSYRQPTFLYESLWNLLGFALILIFRRKWKSLRRGHITAFYLIWYGFGRMVIEGMRTDSLMFFGFRVSQWLSVVLIGLGIMIVIYQNRKKAPYYITEEEN

SEQ ID NO: 51 - protein, 129 aa, Streptococcus pneumoniae
MGKLSSILLGTVSGAALALFLTSDKGKQVCSQAQDFLDDLREDPEYAKEQVCEKLTEVKEQATDFVLKTKEQVESGEITVDSILAQTKSYAFQATEASKNQLNNLKEQWQEKAEALDDSEEIVIDITEE

SEQ ID NO: 52 - protein, 205 aa, Streptococcus pneumoniae
MKTKLIFWGSMLFLLSLSILLTIYLAWIFYPMEIQWLNLTNRVYLKPETIQYNFHILMNYLTNPFSQVLQMPDFRSSAAGLHHFAVVKNLFHLVQLVALVTLPSFYVFVNRIVKKDFLSLYRKSLLALVVLPVMIGLGGVLIGFDQFFTLFHQILFVGDDTWLFDPAKDPVIMILPETFFLHAFLLFFALYENFFGYLYLKSRRK

SEQ ID NO: 53 - protein, 637 aa, Streptococcus pneumoniae
MTYHFTEEYDIIVIGAGHAGVEASLAASRMGCKVLLATINIEMLAFMPCNPSIGGSAKGIVVREVDALGGEMAKTIDKTYIQMKMLNTGKGPAVRALRAQADKELYSKEMRKTVENQENLTLRQTMIDEILVEDGKVVGVRTATHQEYAAKAVIVTTGTALRGEIIIGDLKYSSGPNHSLASINLADNLKELGLEIGRFKTGTPPRVKASSINYDVTEIQPGDEVPNHFSYTSRDEDYVKDQVPCWLTYTNGTSHEIIQNNLHRAPMFTGVVKGVGPRYCPSIEDKIVRFADKERHQLFLEPEGRNTEEVYVQGLSTSLPEDVQRDLVHSIKGLENAEMMRTGYAIEYDMVLPHQLRATLETKKISGLFTAGQTNGTSGYEEAAGQGIIAGINAALKIQGKPELILKRSDGYIGVMIDDLVTKGTIEPYRLLTSRAEYRLILRHDNADMRLTEMGREIGLVDDERWARFEIKKNQFDNEMKRLDSIKLKPVKETNAKVEEMGFKPLTDAVTAKEFLRRPEVSYQDVVAFIGPAAEDLDDKIIELIETEIKYEGYISKAMDQVAKMKRMEEKRIPANIDWDDIDSIATEARQKFKLINPETIGQASRISGVNPADISILMVYLEGKNRSISKTLQKSK

SEQ ID NO: 54 - protein, 185 aa, Streptococcus pneumoniae
MTKQVLLVDDEEHILKLLDYHLSKEGFSTQLVTNGRKALALAETEPFDFILLDIMLPQLDGMEVCKRLRAKGVKTPIMMVSAKSDEFDKVLALELGADDYLTKPFSPRELLARVKAVLRRTKGEQEGDDSDNIADDSWLFGTLKVYPERHEVYKANKLLSLTPKEFESDKNPFFEVFKVSKVTAQ

SEQ ID NO: 55 - protein, 478 aa, Streptococcus pneumoniae
MTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVVFKRYKDKVKYWMTFNEINNQANYQEDFAPFTNSGIVYEEGDNREAIMYQAAHYELVASARAVKIGHEINPDFQIGCMIAMCPIYPVTCNPKDILMAMKAMQKRYYFADVHVLGKYPEHIFKYWERKGISVDFTAQDKEDLLGGTVDYIGFSYYMSFAIDSHRENNPYFDYLETEDLVKNNYVKASEWEWQIDPEGLRYALNWFTDHYHLPLFIVENGFGAIDQVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 56 - protein, 448 aa, Streptococcus pneumoniae
MDQQNGLFGFLENHVMGPMGKLAQFKVVRAITAAGMAAVPFTIVGSMFLVFSILPQAFSFWPIVADIFSASFDKFTSLYMVANYATMGSLSLYFVLSLAYELTKIYAEEEELNMNPLNGALLALMAFVMTVPQIIFDGGMMKTVTSLKEGAVIADGWAMGNVVARFGTTGIFTAIIMAIVTVLIYRMCVKHNWVIKMPEAVPEGVSRGFTALVPGFVVAFVVIFINGLLVAMGTDIFKVIAIPFGFVSNLTNSWIGLMIIYLLTQLLWIVGIHGANIVFAFVSPIALANMAENAAGGHFAVAGEFSNMFVIAGGSGATLGLCLYIAFASKSEQLKAIGRASVVPALFNINEPLIFGLPIIYNPALAIPFILAPMVTATIYYVANSLNFIKPIIAQVPWPTPVGIGAFLGTADLRAVLVALVCAFAAFLVYLPFIRVYDQKLVKEEQGI

SEQ ID NO: 57 - protein, 657 aa, Streptococcus pneumoniae
MKKFYVSPIFPILVGLIAFGVLSTFIIFVNNNLLTVLILFLFVGGYVFLFKKLRVHYTRSDVEQIQYVNHQAEESLTALLEQMPVGVMKLNLSSGEVEWFNPYAELILTKEDGDFDLEAVQTIIKASVGNPSTYAKLGEKRYAVHMDASSGVLYFVDVSREQAITDELVTSRPVIGIVSVDNYDDLEDETSESDISQINSFVANFISEFSEKHMMFSRRVSMDRFYLFTDYTVLEGLMNDKFSVIDAFREESKQRQLPLTLSMGFSYGDGNHDEIGKVALLNLNLAEVRGGDQVVVKENDETKNPVYFGGGSAASIKRTRTRTRAMMTAISDKIRSVDQVFVVGHKNLDMDALGSAVGMQLFASNVIENSYALYDEEQMSPDIERAVSFIEKEGVTKLLSVKDAMGMVTNRSLLILVDHSKTALTLSKEFYDLFTQTIVIDHHRRDQDFPDNAVITYIESGASSASELVTELIQFQNSKKNRLSRMQASVLMAGMMLDTKNFTSRVTSRTFDVASYLRTRGSDSIAIQEIAATDFEEYREVNELILQGRKLGSDVLIAEAKDMKCYDTVVISKAADAMLAMSGIEASFVLAKNTQGFISISARSRSKLNVQRIMEELGGGGHFNLAAAQIKDVTLSEAGEKLTEIVLNEMKEKEKEE

SEQ ID NO: 58 - protein, 235 aa, Streptococcus pneumoniae
MKEKNMWKELLNRAGWILVFLLAVLLYQVPLVVTSILTLKEVALLQSGLIVAGLSIVVLALFIMGARKTKLASFNFSFFRAKDLARLGLSYLVIVGSNILGSILLQLSNETTTANQSQINDMVQNSSLISSFFLLALLAPICEEILCRGIVPKKIFRGKENLGFVVGTIVFALLHQPSNLPSLLIYGGMSTVLSWTAYKTQRLEMSILLHMIVNGIAFCLLALVVIMSRTLGISV

SEQ ID NO: 59 - protein, 235 aa, Streptococcus pneumoniae; identical to SEQ ID NO: 58

SEQ ID NO: 60 - protein, 533 aa, Streptococcus pneumoniae
MDTQKIEAAVKMIIEAVGEDANREGLQETPARVARMYQEIFSGLGQTAEEHLSKSFEIIDDNMVVEKDIFFHTMCEHHFLPFYGRAHIAYIPDGRVAGLSKLARTVEVYSKKPQIQERLNIEVADALMDYLGAKGAFVVIEAEHMCMSMRGVRKPGTATLTTVARGLFETDKDLRDQAYRLMGLMKDLFLKRKQAFRKECLGYLRYVLNDHFVLFLLVLLGFLAYQYSQLLQHFPENHWPILLFVGITSVLLLLWGGTATYMEAPDKLFLLVGEEEIKLHLKRQTGISLVFWLFVQTLFLLLFAPLFLAMGYGLPVFLLYVLLLGVGKYFHFCQKASKFFTETGLDWDYVISQESKRKQVLLRFFALFTQVKGISNSVKRRAYLDFILKAVQKVPGKIWQNLYLRSYLRNGDLFALSLRLLLLSLLAQVFIEQAWIATAVVVLFNYLLLFQLLALYHAFDYQYLTQLFPLDKGQKEKGLQEVVRGLTSFVLLVELVVGLITFQEKLALLALLGAGLVLLVLYLPYQVKRQMQD

SEQ ID NO: 61 - protein, 398 aa, Streptococcus pneumoniae
MRKSIVLAADNAYLIPLETTIKSVLYHNRDVDFYILNSDIAPEWFKLLGRKMEVVNSTIRSVHIDKELFESYKTGPHINYASYFRFFATEVVESDRVLYLDSDIIVTGELATLFEIDLKGYSIGAVDDVYAYEGRKSGFNTGMLLMDVAKWKEHSIVNSLLELAAEQNQVVHLGDQSILNIYFEDNWLALDKTYNYMVGIDIYHLAQECERLDDNPPTIVHYASHDKPWNTYSISRLRELWWVYRDLDWSEIAFQRSDLNYFERSNQSKKQVMLVTWSADIKHLEYLVQRLPDWHFHLAAPCDCSEELTSLSQYTNVTVYQNVLHSRIDWLLDDSIVYLDINTGGEVFNVVTRAQESGKKIFAFDITRKSMDDGLYDGIFSVERPDDLVDRMKNIEIE

SEQ ID NO: 62 - protein, 405 aa, Streptococcus pneumoniae
MTKIYSSIAVKKGLFTSFLLFIYVLGSRIILPFVDLNTKDFLGGSTAYLAFSAALTGGNLRSLSIFSVGLSPWMSAMILWQMFSFSKRLGLTSTSIEIQDRRKMYLTLLIAVIQSLAVSLRLPVQSSYSAILVVLMNTILLIAGTFFLVWLSDLNASMGIGGSIVILLSSMVLNIPQDVLETFQTVHIPTGIIVLLALLTLVFSYLLALMYRARYLVPVNKIGLHNRFKRYSYLEIMLNPAGGMPYMYVMSFLSVPAYLFILLGFIFPNHSGLAALSKEFMVGKPLWVYVYISVLFLFSIIFAFVTMNGEEIADRMKKSGEYIYGIYPGADTSRFINRLVLRFSVIGGLFNVIMAGGPMLFVLFDEKLLRLAMIPGLFMMFGGMIFTIRDEVKALRLNETYRPLI

SEQ ID NO: 63 - protein, 763 aa, Streptococcus pneumoniae
MSSLSDQELVAKTVEFRQRLSEGESLDDILVEAFAVVREADKRILGMFPYDVQVMGAIVMHYGNVAEMNTGEGKTLTATMPVYLNAFSGEGVMVVTPNEYLSKRDAEEMGQVYRFLGLTIGVPFTEDPKKEMKAEEKKLIYASDIIYTTNSNLGFDYLNDNLASNEEGKFLRPFNYVIIDEIDDILLDSAQTPLIIAGSPRVQSNYYAIIDTLVTTLVEGEDYIFKEEKEEVWLTTKGAKSAENFLGIDNLYKEEHASFARHLVYAIRAHKLFTKDKDYIIRGNEMVLVDKGTGRLMEMTKLQGGLHQAIEAKEHVKLSPETRAMASITYQSLFKMFNKISGMTGTGKVAEKEFIETYNMSVVRIPTNRPRQRIDYPDNLYITLPEKVYASLEYIKQYHAKGNPLLVFVGSVEMSQLYSSLLFREGIAHNVLNANNAAREAQIISESGQMGAVTVATSMAGRGTDIKLGKGVAELGGLIVIGTERMESQRIDLQIRGRSGRQGDPGMSKFFVSLEDDVIKKFGPSWVHKKYKDYQVQDMTQPEVLKGRKYRKLVEKAQHASDSAGRSARRQTLEYAESMNIQRDIVYKERNRLIDGSRDLEDVVVDIIERYTEEVAADHYASRELLFHFIVTNISFHVKEVPDYIDVTDKTAVRSFMKQVIDKELSEKKELLNQHDLYEQFLRLSLLKAIDDNWVEQVDYLQQLSMAIGGQSASQKNPIVEYYQEAYAGFEAMKEQIHADMVRNLLMGLVEVTPKGEIVTHFP

SEQ ID NO: 64 - protein, 319 aa, Streptococcus pneumoniae
MIGTFAAALVAVLANFIVPIEITPNSANTEIAPPDGIGQVLSNLLLKLVDNPVNALLTANYIRILSWAVIFGIAMREASKNSQELLKTIADVTSKIVEWIINLAPFGILGLVFKTISDKGVGSLANYGILLVLLVTTMLFVAPVVNPLIAFFFMRRNPYPLVWNCLRVSGVTAFFTRSSATNIPVNMKLCHDLGLNPDTYSVSIPLGSTINMAGVAITINLLTLAAVNTLGIPVDFATAFVLSVVAAISSCDASGIAGGSLLLIPVACSLFGISNDIAIQIVGVGFVIGVIQDSCETALNSSTDVLFTAVAEYAATRKK

SEQ ID NO: 65 - protein, 317 aa, Streptococcus pneumoniae
MSISQRTTKLILATCLACLLAYFLNLSSAVSAGIIALLSLSDTRRSTLKLARNRLFSMLLALAIGVLAFHLSGFHIWSLGLYLAFYVPLAYKMGWEIGITPSTVLVSHLLVQESTSPDLLVNEFLLFAIGTGFALLVNLYMPSREEEIQHYHTLVEEKLKDILQRFKYYLSRGDGRNRAQLVAELDTLLKEALRLVYLDHSDHLFHQTDYHIHYFEMRQRQSRILRNMAQQINTCHLAASESLILAQLFSKIAGQLSQTNPASDLLDEIERYLEVFRNRSLPKTREEFETRATLLQLLREAKTFIQVKVDFYQKYRQ

SEQ ID NO: 66 - protein, 537 aa, Streptococcus pneumoniae
MEIMSLAIAVFAVIIGLVIGYVSISAKMKSSQEAAELMLLNAEQEATNLRGQAEREADLLVNEAKRESKSLKKEALLEAKEEARKYREEVDAEFKSERQELKQIESRLTERATSLDRKDDNLTSKEQTLEQKEQSISDRAKNLDAREEQLEEVERQKEAELERIGALSQAEARDIILAQTEENLTREIASRIREAEQEVKERSDKMAKDILVQAMQRIAGEYVAESTNSTVHLPDDTMKGRIIGREGRNIRTFESLTGVDVIIDDTPEVVTLSGFDPIRREIARMTMEMLLKDGRIHPARIEELVEKNRQEIDNKIREYGEAAAYEIGAPNLHPDLMKIMGRLQFRTSYGQNVLRHSIEVAKLAGIMASELGENAALARRAGFLHDIGKAIDHEVEGSHVEIGMELARKYKEPPVVVNTIASHHGDVEAESVIAVIVAAADALSAARPGARSESLESYIKRLHDLEEIANGFEGVQTSFALQAGREIRIMVNPGKIKDDKVTILAHKVRKKIENNLDYPGNIKVTVIRELRAVDYAK

SEQ ID NO: 67 - protein, 104 aa, Streptococcus pneumoniae
MMLKPSIDTLLDKVPSKYSLVILEAKRAHELEAGAPATQGFKSEKSTLRALEEIESGNVTIHPDPEGKREAVRRRIEEEKRRKEEEEKKIKEQIAKEKEDGEKI

SEQ ID NO: 68 - protein, 263 aa, Streptococcus pneumoniae
MSAYQLPTVWQDEASNQGAFTGLNRPTAGARFEQNLPKGEQAFQLYSLGTPNGVKVTILLEELLEAGFKEAAYDLYKIAIMDGDQFGSDFVKLNPNSKIPALLDQSGTENVRVFESAHILLYLAEKFGAFLPSNPVEKVEVLNWLFWQAGAAPFLGGGFGHFFNYAPEKLEYPINRFTMEVKRQLDLLDKELAQKPYIAGNDYTIADIAIWSWYGQLVQGNLYQGSAKFLDASSYQNLVKWAEKIANRPAVKRGLEVTYTEIK

SEQ ID NO: 69 - protein, 312 aa, Streptococcus pneumoniae
LASLITSIIMFYVGFDVLRDTIQKILSREETVIDPLGATLGIISAAIMFVVYLYNTRLSKKSNSNALKAAAKDNLSDAVTSLGTAIAILASSFNYPIVDKLVAIIITFFILKTAYDIFIESSFSLSDGFDDRLLEDYQKAIMEIPKISKVKSQRGRTYGSNIYLDITLEMNPDLSVFESHEIADQVESMLEERFGVFDTDVHIEPAPIPEDEILDNVYKKLLMREQLIDQGNQLEELLTDDFVYIRQDGEQMDKEAYKTKKELNSAIKDIQITSISQKTKLICYELDGIIHTSIWRRHETWQNIFHQETKKE

SEQ ID NO: 70 - protein, 264 aa, Streptococcus pneumoniae
MTIKLVATDMDGTFLDGNGRFDMDRLKSLLVSYKEKGIYFAVASGRGFLSLEKLFAGVRDDIIFIAENGSLVEYQGQDLYEATMSRDFYLATFEKLKTSPYVDINKLLLTGKKGSYVLDTVDETYLKVSQHYNENIQKVASLEDITDDIFKFTTNFTEETLEDGEAWVNENVPGVKAMTTGFESIDIVLDYVDKGVAIVELVKKLGITMDQVMAFGDNLNDLHMMQVVGHPVAPENARPEILELAKTVIGHHKERSVIAYMEGL

SEQ ID NO: 71 - protein, 272 aa, Streptococcus pneumoniae
MADIKLIALDLDGTLLTTDKRLTDRTKETLQAARDRGIKVVLTTGRPLKAMDFFLHELGTDGQEDEYTITFNGGLVQKNTGEILDKTVFSYDDVARLYEETEKLSLPLDAISEGTVYQIQSDQESLYAKFNPALTFVPVDFEDLSSQMTYNKCVTAFAQEPLDAAIQKISPELFDQYEIFKSREMLLEWSPKNVHKATGLAKLISHLGIDQSQVMACGDEANDLSMIEWAGLGVAMQNAVPEVKAAANVVTPMTNDEEAVAWAIEEYVLKEN

SEQ ID NO: 72 - protein, 418 aa, Streptococcus pneumoniae
MESLLILLLIANLAGLFLIWQRQDRQEKHLSKSLEDQADHLSDQLDYRFDQARQASQLDQKDLEVVVSDRLQEVRIELHQGLTQVRQEMTDNLLQTRDKTDQRLQALQESNEQRLEQMRQTVEEKLEKTLQTRLQASFETVSKQLESVNRGLGEMQTVARDVGALNKVLSGTKTRGILGELQLGQIIEDIMTPAQYEREYATVENSSERVEYAIKLPGQGDQEYVYLPIDSKFPLADYYRLEEAYETGDKDEIERCRKSLLASVKRFARDIRNKYIAPPRTTNFGVLFVPTEGLYSEIVRNPVFFDDLRREEQIIVAGPSTLSALLNSLSVGFKTLNIQKSADHISKTLASVKTEFGKFGGILVKAQKHLQHASGNIDELLNRRTIAIERTLRHIELSEGEPALDLLHFQENEEEYED

SEQ ID NO: 73 - protein, 313 aa, Streptococcus pneumoniae
MKISHMKKDELFEGFYLIKSADLRQTRAGKNYLAFTFQDDSGEIDGKLWDAQPHNIEAFTAGKVVHMKGRREVYNNTPQVNQITLRLPQAGEPNDPADFKVKSPVDVKEIRDYMSQMIFKIENPVWQRIVRNLYTKYDKEFYSYPAAKTNHHAFETGLAYHTATMVRLADAISEVYPQLNKSLLYAGIMLHDLAKVIELTGPDQTEYTVRGNLLGHIALIDSEITKTVMELGIDDTKEEVVLLRHVILSHHGLLEYGSPVRPRIMEAEIIHMIDNLDASMMMMSTALALVDKGEMTNKIFAMDNRSFYKPDLD

SEQ ID NO: 74 - protein, 503 aa, Streptococcus pneumoniae
MSEKAKKGFKMPSSYTVLLIIIAIMAVLTWFIPAGAFIEGIYETQPQNPQGIWDVLMAPIRAMLGTHPEEGSLIKETSAAIDVAFFILMVGGFLGIVNKTGALDVGIASIVKKYKGREKMLILVLMPLFALGGTTYGMGEETMAFYPLLVPVMMAVGFDSLTGVAIILLGSQIGCLASTLNPFATGIASATAGVGTGDGIVLRLIFWVTLTALSTWFVYRYADKIQKDPTKSLVYSTRKEDLKHFNVEESSSVESTLSSKQKSVLFLFVLTFILMVLSFIPWTDLGVTIFDDFNTWLTGLPVIGNIVGSSTSALGTWYFPEGAMLFAFMGILIGVIYGLKEDKIISSFMNGAADLLSVALIVAIARGIQVIMNDGMITDTILNWGKEGLSGLSSQVFIVVTYIFYLPMSFLIPSSSGLASATMGIMAPLGEFVNVRPSLIITAYQSASGVLNLIAPTSGIVMGALALGRINIGTWWKFMGKLVVAIIVVTIALLLLGTFLPFL

SEQ ID NO: 75 - protein, 782 aa, Streptococcus pneumoniae
MSNSFVKLLVSQLFANLADIFFRVTIIANIYIISKSVIATSLVPILIGISSFVASLLVPLVTKRLALNRVLSLSQFGKTILLAILVGMFTVMQSVAPLVTYLFVVAISILDGFAAPVSYAIVPRYATDLGKANSALSMTGEAVQLIGWGLGGLLFATIGLLPTTCINLVLYIISSFLMLFLPNAEVEVLESETNLEILLKGWKLVARNPRLRLFVSANLLEIFSNTIWVSSIILVFVTELLNKTESYWGYSNTAYSIGIIISGLIAFRLSEKFLAAKWEPQLFTPNLKTIQNPCLSLDPGWFLFSPNGCFLLDKKEFPLYGISVEKNTKRKETHMNSLPNHHFQNKSFYQLSFDGGHLTQYGGLIFFQELFSQLKLKERISKYLVTNDQRRYCRYSDSDILVQFLFQLLTGYGTDYACKELSADAYFPKLLEGGQLASQPTLSRFLSRTDEETVHSLRCLNLELVEFFLQFHQLNQLIVDIDSTHFTTYGKQEGVAYNAHYRAHGYHPLYAFEGKTGYCFNAQLRPGNRYCSEEADSFITPVLERFNQLLFRMDSGFATPKLYDLIEKTGQYYLIKLKKNTVLSRLGDLSLPCPQDEDLTILPHSAYSETLYQAGSWSHKRRVCQFSERKEGNLFYDVISLVTNMTSGTSQDQFQLYRGRGQAENFIKEMKEGFFGDKTDSSTLIKNEVRMMMSCIAYNLYLFLKHLAGGDFQTLTIKRFRHLFLHVVGKCVRTGRKQLLKLSSLYAYSELFSALYSRIRKVNLNLPVPYEPPRRKASLMMH

SEQ ID NO: 76 - protein, 414 aa, Streptococcus pneumoniae
MMEFFQQLPHLEPYGNPQYFVYVIAATLPIFIGLFFKKRFAWYEVLVSLFFIVTMLVGGKTNQLAALGIYLCWEILLLLFYKHYRKSKDGKWVFYLVSFLSLLPIIFVKVQPAINGTQSLLGFLGISYLTFRSVGIVIELRDGVIKDFTLWEFLRFLLFMPTFSSGPIDRFKRFNENYQAIPERDELMDMLDESVRYIMWGFLYKFILAHVLGETLLPPLKNLALQSGGFFNLYALAVMYTFGLELFFDFAGYSMFALAISNLMGIRSPINFNKPFLSRDLKEFWNRWHMSLSFWFRDFVFMRMVMVLTRKKVFKNRNVTSSMAYIVNMLIMGFWHGVTWYYIAYGLFHGLGLVINDAWVRKKKTLNKERKKAGKAALPENRWIQLLGMVVTFHVVMLSFLIFSGFLNNLWFKK

SEQ ID NO: 77 - protein, 422 aa, Streptococcus pneumoniae
MLKRLWMIFGPVLIAGLLVFLLIFFYPTEMHHNLGAEKRSAVATTIDSFKERSQKVRALSDPNVRFVPFFGSSEWLRFDGAHPAVLAEKYNRSYRPYLLGQGGAASLNQYFGMQQMLPQLENKQVVYVISPQWFSKNGYDPAAFQQYFNGDQLTSFLKHQSGDQASQYAATRLLQQFPNVAMKDLVQKLASKEELSTADNEMIELLARFNERQASFFGQFSVRGYVNYDKHVAKYLKILPDQFSYQAIEDVVKADAEKNTSNNEMGMENYFYNEQIKKDLKKLKDSQKSFTYLKSPEYNDLQLVLTQFSKSKVNPIFIIPPVNKKWMNYAGLREDMYQQTVQKIRYQLESQGFTNIADFSKDGGEPFFMKDTIHLGWLGWLAFDKAVDPFLSNPTPAPTYHLNERFFSKDWATYDGDVKEFQ

SEQ ID NO: 78 - protein, 206 aa, Streptococcus pneumoniae
MEKNLKALKQTTDQEGPAIEPEKAEDTKTVQNGYFEDAAVKDRTLSDYAGNWQSVYPFLEDGTFDQVFDYKAKLTGKMTQAEYKAYYTKGYHTDVTKINITDNTMEFVQGGQSKKYTYKYVGKKILTYKKGNRGVRFLFEATDADAGQFKYVQFSDHNVAPVKAEHFHIFFGGTSQEALFEEMDNWPTYYPDNLSGQEIAQEMLAH

SEQ ID NO: 79 - protein, 147 aa, Streptococcus pneumoniae
MKDGHLLAHHIRLLNGRIFQKLLSQDPEALYRGEQGKILAVLWNSETGCATATDIALATGLANNTLTTMIKKLEEQKLVIVSPCGKDKRKKYLVLTELGKSQKEVGHRVSQKLDTIFYKGFSEEEIHQFEGFQERILANLKEKGNEV

SEQ ID NO: 80 - protein, 506 aa, Streptococcus pneumoniae
MTNLIATFQDRFSDWLTALSQHLQLSLLTLLLAILLAIPLAVFLRYHEKLADWVLQIAGIFQTIPSLALLGLFIPLMGIGTLPALTALVIYAIFPILQNTITGLKGIDPNLQEAGIAFGMTRWERLKKFEIPLAMPVIMSGIRTAAVLIIGTATLAALIGAGGLGSFILLGIDRNNASLILIGALSSAVLAIAFNFLLKVMEKAKLRTIFSGFALVALLLGLSYSPALLVQKEKENLVIAGKIGPEPEILANMYKLLIEENTSMTATVKPNFGKTSFLYEALKKGDIDIYPEFTGTVTESLLQPSPKVSHEPEQVYQVARDGIAKQDHLAYLKPMSYQNTYAVAVPKKIAQEYGLKTISDLKKVEGQLKAGFTLEFNDREDGNKGLQSMYGLNLNVATIEPALRYQAIQSGDIQITDAYSTDAELERYDLQVLEDDKQLFPPYQGAPLMKEALLKKHPELERVLNTLAGKITESQMSQLNYQVGVEGKSAKQVAKEFLQEQGLLKK

SEQ ID NO: 81 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 82 - protein, 299 aa, Streptococcus pneumoniae
MRNMKAKYAVWVAFFLNLTYAIVEFIAGGVFGSSAVLADSVHDLGDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 83 - protein, 242 aa, Streptococcus pneumoniae
MIEYKNVALRYTEKDVLRDVNLQIEDGEFMVLVGPSGSGKTTMLKMINRLLEPTDGNIYMDGKRIKDYDERELRLSTGYVLQAIALFPNLTVAENIALIPEMKGWSKEEITKKTEELLAKVGLPVAEYGHRLPSELSGGEQQRVGIVRAMIGQPKIFLMDEPFSALDAISRKQLQVLTKELHKEFGMTTIFVTHDTDEALKLADRIAVLQDGEIRQVANPETILKAPATDFVADLFGGSVHD

SEQ ID NO: 84 - protein, 360 aa, Streptococcus pneumoniae
MSAVAISAMTKVMQETHGNPSSIHGHGRQAGKLLREARQELAQLLRTKPQHIFFTSGGTEGNNTTIIGYCLRHQEQGKHIITTAIEHHAVLETIDYLVQHFGFEATIIQPENQEITAQQIQKALRDDTILVSTMFVNNETGNLLPIAEIGQILKQHPAAYHVDAVQAIGKIPIHSEELGIDFLTASAHKFHGPKGIGFLYASSMDFDSYLHGGDQEQKKRAGTENLPAIVGMVAALKEDLEKQEEHFQHVQNLETAFLAELEGIQYYLNRGKHHLPYVLNIGFPGQKNDLLLLRLDLAGISISTGSACTAGVVQSSHVLEAMYGANSERLKESLRISLSPQNTVEDLQTLAKTLKEIIGG

SEQ ID NO: 85 - protein, 459 aa, Streptococcus pneumoniae
MLFKLSKEKIELGLSRLSPARRIFLSFALVILLGSLLLSLPFVQVESSRATYFDHLFTAVSAVCVTGLSTLPVAHTYNIWGQIICLLLIQIGGLGLMTFIGVFYIQSKQKLSLRSRATIQDSFSYGETRSLRKFVYSIFLTTFLVESLGAILLSFRLIPQLGWGRGLFSSIFLAISAFCNAGFDNLGSTSLFAFQTDLLVNLVIAGLIITGGLGFMVWFDLAGHVGRKKKGRLHFHTKLVLLLTIGLLLFGTATTLFLEWNNAGTIGNLPVADKVLVSFFQTVTMRTAGFSTIDYTQAHPVTLLIYILQMFLGGAPGGTAGGLKITTFFVLLVFARSELLGLPHANVARRTIAPRTVQKSFSVFIIFLMSFLIGLILLGITAKGNPPFIHLVFETISALSTVGVTANLTPDLGKLALSVIMPLMFMGRIGPLTLFVSLADYHPEKKDMIHYMKADISIG

SEQ ID NO: 86 - protein, 221 aa, Streptococcus pneumoniae
MSDRTIGILGLGIFGSSVLAALAKQDMNIIAIDDHAERINQFEPVLARGVIGDITDEELLRSAGIDTCDTVVVATGENLESSVLAVMHCKSLGVPTVIAKVKSQTAKKVLEKIGADSVISPEYEMGQSLAQTILFHNSVDVFQLDKNVSIVEMKIPQSWAGQSLSKLDLRGKYNLNILGFREQENSPLDVEFGPDDLLKADTYILAVINNQYLDTLVALNS

SEQ ID NO: 87 - protein, 179 aa, Streptococcus pneumoniae
MKLLSIAISSYNAAAYLHYCVESLVIGGEQVGILIINDGSQDQTQEIAECLASKYPNIVRAIYQENKCHGGAVNRGLVEASGRYFKVVDSDDWVDPRAYLKILETLQELESKGQEVDVFVTNFVYEKEGQSRKKSMSYDSVLPVRQIFGWDQVGNFSKGQYTMMHSLIYRTDLLRASQF

SEQ ID NO: 88 - protein, 623 aa, Streptococcus pneumoniae
MKFNPNQRYTRWSIRRLSVGVASVVVASGFFVLVGQPSSVRADGLNPTPGQVLPEETSGTKEGDLSEKPGDTVLTQAKPEGVTGNTNSLPTPTERTEVSEETSPSSLDTLFEKDEEAQKNPELTDVLKETVDTADVDGTQASPAETTPEQVKGGVKENTKDSIDVPAAYLEKAEGKGPFTAGVNQVIPYELFAGDGMLTRLLLKASDNAPWSDNGTAKNPALPPLEGLTKGKYFYEVDLNGNTVGKQGQALIDQLRANGTQTYKATVKVYGNKDGKADLTNLVATKNVDININGLVAKETVQKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQLALDGNVAGKEKQALIDQFRANGTQTYSATVNVYGNKDGKPDLDNIVATKKVTININGLISKETVQKAVADNVKTVSMFQQPT

SEQ ID NO: 89 - protein, 350 aa, Streptococcus pneumoniae
MKLKSYILVGYIISTLLTILVVFWAVQKMLIAKGEIYFLLGMTIVASLVGAGISLFLLLPVFTSLGKLKEHAKRVAAKDFPSNLEVQGPVEFQQLGQTFNEMSHDLQVSFDSLEESEREKGLMIAQLSHDIKTPITSIQATVEGILDGIIKESEQAHYLATIGRQTERLNKLVEELNFLTLNTARNQVETTSKDSIFLDKLLIECMSEFQFLIEQERRDVHLQVIPESARIEGDYAKLSRILVNLVDNAFKYSAPGTKLEVVAKLEKDQLSISVTDEGQGIAPEDLENIFKRLYRVETSRNMKTGGHGLGLAIARELAHQLGGEITVSSQYGLGSTFTLVLNLSGSENKA

SEQ ID NO: 90 - protein, 175 aa, Streptococcus pneumoniae
MFGQTAQHGLTNSLKDFWIFLLNIGPQLAFFCQMLRCSRSVEQGTGNHRREFNMIQQIFSHFGMTHLGQIKLVYQESIDLELLVNALNHHLLIDRLVLTPNQITIEIDRQIVHGLDLLKGRKDKEIIDIKSMFRQLELASTQQICPINQRVHHGILAFGEISDLVPAKNLPNRQD

SEQ ID NO: 91 - protein, 158 aa, Streptococcus pneumoniae
MEHLATYFSTYGGAFFAALGIVLAVGLSGMGSAYGVGKAGQSAAALLKEQPEKFASALILQLLPGTQGLYGFVIGILIWLQLTPELPLEKGVAYFFVALPIAIVGYFSAKHQGNVAVAGMQILAKRPKEFMKGAILAAMVETYAILAFVVSFILTLRV

SEQ ID NO: 92 - protein, 165 aa, Streptococcus pneumoniae
MLKSEKQSRYQMLNEELSFLLEGETNVLANLSNASALIKSRFPNTVFAGFYLFDGKELVLGPFQGGVSCIRIALGKGVCGEAAHFQETVIVGDVTTYLNYISCDSLAKSEIVVPMMKNGQLLGVLDLDSSEIEDYDAMDRDYLEQFVAILLEKTAWDFTMFEEKS

SEQ ID NO: 93 - protein, 256 aa, Streptococcus pneumoniae
MSVLEIKDLHVEIEGKEILKGVNLTLKTGEIAAIMGPNGTGKSTLSAAIMGNPNYEVTKGEVLFDGVNILELEVDERARMGLFLAMQYPSEIPGITNAEFLRAAMNAGKEDDEKISVREFITKLDEKMELLNMKEEMAERYLNEGFSGGEKKRNEILQLLMLEPTFALLDEIDSGLDIDALKVVSKGVNAMRGEGFGAMIITHYQRLLNYITPDVVHVMMEGRVVLSGGPELAARLEREGYAKLAEELGYDYKEEL

SEQ ID NO: 94 - protein, 156 aa, Streptococcus pneumoniae
MPYKRQRSFSMALSKLDSLYMAVVADHSKNPHHQGKLEDAEQISLNNPTCGDVINLSVKFDAEDRLEDIAFLNSGCTISTASASMMTDAVLGKTKQEILELATIFSEMVQGQKDERQDQLGDAAFLSGVAKFPQRIKCATLAWNALKKTIENQEKQ

SEQ ID NO: 95 - protein, 650 aa, Streptococcus pneumoniae
MKIQDLLRKDVMLLDLQATEKTAVIDEMIKNLTDHGYVTDFETFKEGILAREALTSTGLGDGIAMPHSKNAAVKEATVLFAKSNKGVDYESLDGQATDLFFMIAAPEGANDTHLAALAELSQYLMKDGFADKLRQATSADQVIELFDQASEKTEELVQAPANDSGDFIVAVTACTTGIAHTYMAQEALQKVAAEMGVGIKVETNGASGVGNQLTAEDIRKAKAIIIAADKAVEMDRFDGKPLINRPVADGIRKTEELINLALSGDTEVYRAANGAKAATASNEKQSLGGALYKHLMSGVSQMLPFVIGGGIMIALAFLIDGALGVPNENLGNLGSYHELASMFMKIGGAAFGLMLPVFAGYVAYSIAEKPGLVAGFVAGAIAKEGFAFGKIPYAAGGEATSTLAGVSSGFLGALVGGFIAGALVLAIKKYVKVPRSLEGAKSILLLPLLGTILTGFVMLAVNIPMAAINTAMNDFLGGLGGGSAVLLGIVLGGMMAVDMGGPVNKAAYVFGTGTLAATVSSGGSVAMAAVMAGGMVPPLAIFVATLLFKDKFTKEERNSGLTNIIMGLSFITEGAIPFGAADPARAIPSFILGSAVAGGLVGLTGIKLMAPHGGIFVIALTSNALLYLVSVLVGAIVSGVVYGYLRKPQA

SEQ ID NO: 96 - protein, 767 aa, Streptococcus pneumoniae
MANKNTSTTRRRPSKAELERKEAIQRMLISLGIAILLIFAAFKLGAAGITLYNLIRLLVGSLAYLAIFGLLIYLFFFKWIRKQEGLLSGFFTIFAGLLLIFEAYLVWKYGLDKSVLKGTMAQVVTDLTGFRTTSFAGGGLIGVALYIPTAFLFSNIGTYFIGSILILVGSLLVSPWSVYDIAEFFSRGFAKWWEGHERRKEERFVKQEEKARQKAEKEARLEQEETEKALLDLPPVDMETGEILTEEAVQNLPPIPEEKWVEPEIILPQAELKFPEQEDDSDDEDVQVDFSAKEALEYKLPSLQLFAPDKPKDQSKEKKIVRENIKILEATFASFGIKVTVERAEIGPSVTKYEVKPAVGVRVNRISNLSDDLALALAAKDVRIEAPIPGKSLIGIEVPNSDIATVSFRELWEQSQTKAENFLEIPLGKAVNGTARAFDLSKMPHLLVAGSTGSGKSVAVNGIIASILMKARPDQVKFMMVDPKMVELSVYNDIPHLLIPVVTNPRKASKALQKVVDEMENRYELFAKVGVRNIAGFNAKVEEFNSQSEYKQIPLPFIVVIVDELADLMMVASKEVEDAIIRLGQKARAAGIHMILATQRPSVDVISGLIKANVPSRVAFAVSSGTDSRTILDENGAEKLLGRGDMLFKPIDENHPVRLQGSFISDDDVERIVNFIKTQADADYDESFDPGEVSENEGEFSDGDAGGDPLFEEAKSLVIETQKASASMIQRRLSVGFNRATRLMEELEIAGVIGPAEGTKPRKVLQQ

SEQ ID NO: 97 - protein, 175 aa, Streptococcus pneumoniae
MSYFKKYKFDKSQFKLGMRTFKTGIAVFLVLLIFGFFGWKGLQIGALTAVFSLRESFDESVHFGTSRILGNSIGGLYALVFFLLNTFFHEAFWVTLVVVPICTMLTIMTNVAMNNKAGVIGGVAAMLIITLSIPSGETILYVFVRVLETFMGVFVAIIVNYDIDRIRLFLEKKEK

SEQ ID NO: 98 - protein, 156 aa, Streptococcus pneumoniae
MNKSEHRHQLIRALITKNKIHTQAELQALLAENDIQVTQATLSRDIKNMNLSKVREEDSAYYVLNNGSISKWEKRLELYMEDALVWMRPVQHQVLLKTLPGLAQSFGSIIDTLSFPDAIATLCGNDVCLIICEDADTAQKCFEELKKFAPPFFFEE

SEQ ID NO: 99 - protein, 495 aa, Streptococcus pneumoniae
MKSIKLNALSYMGIRVLNIIFPILTGTYVARVLDRTDYGYFNSVDTILSFFLPFATYGVYNYGLRAISNVKDNKKDLNRTFSSLFYLCIACTILTTAVYILAYPLFFTDNPIVKKVYLVMGIQLIAQIFSIEWVNEALENYSFLFYKTAFIRILMLVSIFLFVKNEHDIVVYTLVMSLSTLINYLISYFWIKRDIKLVKIHLSDFKPLFLPLTAMLVFANANMLFTFLDRLFLVKTGIDVNVSYYTIAQRIVTVIAGVVTGAIGVSVPRLSYYLGKGDKEAYVSLVNRGSRIFNFFIIPLSFGLMVLGPNAILLYGSEKYIGGGILTSLFAFRTIILALDTILGSQILFTNGYEKRITVYTVFAGLLNLGLNSLLFFNHIVAPEYYLLTTMLSETSLLVFYIIFIHRKQLIHLGHIFSYTVRYSLFSLSFVAIYFLINFVYPVDMVINLPFLINTGLIVLLSAISYISLLVFTKDSIFYEFLNHVLALKNKFKKS

SEQ ID NO: 100 - protein, 286 aa, Streptococcus pneumoniae
MELFMKITNYEIYKLKKSGLTNQQILKVLEYGENVDQELLLGDIADISGCRNPAVFMERYFQIDDAHLSKEFQKFPSFSILDDCYPWDLSEIYDAPVLLFYKGNLDLLKFPKVAVVGSRACSKQGAKSVEKVIQGLENELVIVSGLAKGIDTAAHMAALQNGGKTIAVIGTGLDVFYPKANKRLQDYIGNDHLVLSEYGPGEQPLKFHFPARNRIIAGLCRGVIVAEAKMRSGSLITCERAMEEGRDVFAIPGSILDGLSDGCHHLIQEGAKLVTSGQDVLAEFEF

SEQ ID NO: 101 - protein, 267 aa, Streptococcus pneumoniae
MKQLTVEDAKQIELEILDYIDTLCKKHNINYIINYGTLIGAVRHEGFIPWDDDIDLSMPREDYQRFINIFQKEKSKYKLLSLETDKNYFNNFIKITDSTTKIIDTRNTKTYESGIFIDIFPIDRFDDPKVIDTCYKLESFKLLSFSKHKNIVYKDSLLKDWIRTAFWLLLRPVSPRYFANKIEKEIQKYSRENGQYMAFIPSKFKEKEVFPSGTFDKTIDLPFENLSLPAPEKFDTILTQFYGDYMTLPPEEKRFYSHEFHAYKLED

SEQ ID NO: 102 - protein, 508 aa, Streptococcus pneumoniae
MIKINHLTITQNKDLRDLVSDLTMTIQDGEKVAIIGEEGNGKSTLLKILMGEALSDFTIKGNIQSDYQSLAYIPQKVPEDLKKKTLHDYFFLDSIDLDYSILYRLAEELHFDSNRFASDQEIGNLSGGEALKIQLIHELAKPFEILFLDEPSNDLDLETVDWLKGQIQKTRQTVIFISHDEDFLSETADTIVHLRLVKHRKEAETLVEHLDYDSYSEQRKANFAKQSQQAANNQRAYDKTMEKHRRVKQNVETALRATKDSTAGRLLAKKMKTVLSQEKRYEKAAQSMTQKPLEEEQIQLFFSDIQPLPASKVLVQLEKENLSIDDRVLVQKLQLTVRGQEKIGIIGPNGVGKSTLLAKLQRLLNDKREISLGFMPQDYHKKLQLDLSPIAYLSKTGEKEELQKIQSHLASLNFSYPEMQHQIRSLSGGQQGKLLLLDLVLRKPNFLLLDEPTRNFSPTSQPQIRKLFATYPGGLITVSHDRRFLKEVCSIIYRMTEHGLKLVNLEDL

SEQ ID NO: 103 - protein, 237 aa, Streptococcus pneumoniae
MKPKTFYNLLAEQNLPLSDQQKEQFERYFELLVEWNEKINLTAITDKEEVYLKHFYDSIAPILQGLIPNETIKLLDIGAGAGFPSLPMKILYPELDVTIIDSLNKRINFLQLLAQELDLNGVHFYHGRAEDFAQDKNFRAQYDFVTARAVARMQVLSELTIPYLKVGGKLLALKASNAPEELLEAKNALNLLFSKVEDNLSYALPNRDPRYITVVEKKKETPNKYPRKAGMPNKRPL

SEQ ID NO: 104 - protein, 268 aa, Streptococcus pneumoniae
MSIKLIAVDIDGTLVNSQKEITPEVFSAIQDAKEAGVKVVIATGRPIAGVAKLLDDLQLRDEGDYVVTFNGALVQETATGHEIISESLTYEDYLDMEFLSRKLGVHMHAITKDGIYTANRNIGKYTVHESTLVSMPIFYRTPEEMAGKEIVKCMFIDEPEILDAAIEKIPAEFYERYSINKSAPFYLELLKKNVDKGSAITHLAEKLGLTKDETMAIGDEENDRAMLEVVGNPVVMENGNPEIKKIAKYITKTNDESGVAHAIRTWVL

SEQ ID NO: 105 - protein, 186 aa, Streptococcus pneumoniae
MTWIILGVIALIVIFVIVSYNGLVKNRMQTKEAWSQIDVQLKRRNDLLPNLIETVKGYAKYEGSTLEKVAELRNQVAAATSPAEAMKASDALTRQVSGIFAVAESYPDLKASANFVKLQEELTNTENKISYSRQLYNSVVSNYNVKLETFPSNIIAGMFGFKAADFLQTPEEEKSVPKVDFSGLGD

SEQ ID NO: 106 - protein, 299 aa, Streptococcus pneumoniae
MLFDQIASNKRKTWILLLVFFLLLALVGYAVGYLFIRSGLGGLVIALIIGFIYALSMIFQSTEIVMSMNGAREVDEQTAPDLYHVVEDMALVAQIPMPRVFIIDDPALNAFATGSNPQNAAVAATSGLLAIMNREELEAVMGHEVSHIRNYDIRISTIAVALASAITMLSSMAGRMMWWGGAGRRRSDDDRDGNGLEIIMLVVSLLAIVLAPLAATLVQLAISRQREFLADASSVELTRNPQGMINALDKLDNSKPMSRHVDDASSALYINDPKKGGGFQKLFYTHPPISERIERLKQM

SEQ ID NO: 107 - protein, 180 aa, Streptococcus pneumoniae
MKLNIQEIRKQSEGLNFEQTLDLVDDLRARNQEILDVKDILAVGKVQYEDRMYFLDYQLSYTIVLASSRSMEPVELVESYPVTEVFMEGATNQLDQEVLDDDLVLPIENGELDLAESVSDNILLNIPIKVLTAEEEAGQGFISGNDWQIMTEEEYQAQKAVKKEENSPFAGLQGLFDGDE

SEQ ID NO: 108 - protein, 177 aa, Streptococcus pneumoniae
MKRQLALVVFSGGQDSTTCLFWVMQHYETVEAVTFAYGQRHHLEIQITREIAKEQGIRHHILDMSLLGQITAQPDFATIHISYIPDKLCVESKSLKLYLFSYRNHGDFHENCINTIGKDLVNLLDPRYLEVWGKFTPRGGISIDPYYNYGKQGTKYEGLAEQRLFQHDLYPEKIDNR

SEQ ID NO: 109 - protein, 1236 aa, Streptococcus pneumoniae
MTETVEDKVSHSITGLDILKGIVAAGAVISGTVATQTKVFTNESAVLEKTVEKTDALATNDTVVLGTISTSNSASSTSLSASESASTSASESASTSASTSASTSASESASTSASTSISASSTVVGSQTAAATEATAKKVEEDRKKPASDYVASVTNVNLQSYAKRRKRSVDSIEQLLASIKNAAVFSGNTIVNGAPAINASLNIAKSETKVYTGEGVDSVYRVPIYYKLKVTNDGSKLTFTYTVTYVNPKTNDLGNISSMRPGYSIYNSGTSTQTMLTLGSDLGKPSGVKNYITDKNGRQVLSYNTSTMTTQGSGYTWGNGAQMNGFFAKKGYGLTSSWTVPITGTDTSFTFTPYAARTDRIGINYFNGGGKVVESSTTSQSLSQSKSLSVSASQSASASASTSASASASTSASASASTSASASASTSASVSASTSASASASTSASASASTSASESASTSASASASTSASASASTSASASASTSASESASTSASASASTSASESASTSASASASTSASASASTSASGSASTSTSASASTSASASASTSASASASISASESASTSASESASTSTSASASTSASESASTSASASASTSASASASTSASASASTSASASTSASESASTSASASASTSASASASTSASASASTSASASASTSASVSASTSASASASTSASASASTSASESASTSASASASTSASASASTSASASASTSASESASTSASASASTSASESASTSASASASTSASASASTSASGSASTSTSASASTSASASASTSASASASISASESASTSASESASTSTSASASTSASESASTSASASASTSASASASTSASASARQVRRPQPVHLNRHQPVRQPQQVLVHQLQHQRVHRLQHQPVPRLQRQPVRQLQQVPVLQSQHQQVLQPQHRQVPRLQQAHQHLNQRRQAPQLQQVPVRQPQRRQVRQPQQVLVHQLQHQRVHRLRRQPVHQSQQVPVRQLPHQQVPRLQQAPVRRLQQVLAPQPQPQPVRQPQQVSQRLNRHQRVRPLQQVLAPQPQRQQVHRLQRQRVRLNRHQRVRPLQQVLAPQPQRQQVHRLQHQRVRPLQQVLAPQPQRQQVHRLQRQRVRLSQHQRVRQPQQAHQLLNLHQPVRQPQHRQAPQLQQVPVRQPQRRQVRRLQQVPVRQPQQVPVRQPQRRQVRRPQPVHLNRHQPVRQPQQVLVHQLQHQRVHRLQHQPVHQSQQVPVRQFRINKCLGFSKY

SEQ ID NO: 110 - protein, 449 aa, Streptococcus pneumoniae
MGVETWFYSSICWLAIGLGSVWKFPYMTAANGGGGFLLIFLISTILIGFPLLLAEFALGRSAGVSAIKTFGKLGKNNKYNFIGWIGAFALFILLSFYSVIGGWILVYLGIEFGKLFQLGGTGDYAQLFTSIISNPAIALGAQAAFILLNIFIVSRGVQKGIERASKVMMPLLFIVFVFIIGRSLSLPNAMEGVLYFLKPDFSKLTSTGLLYALGQSFFALSLGVTVMLTYASYLDKKTNLVQSGISIVAMNISISIMAGLAIFQARSPFNIQSEGGPSLLFIVLPQLFDKMPFGTIFYVLFLLLFLFATVTFSVVMLEINVDNITNQDNSKRAKWSVILGILTFVFGIPSALSYGVMADVHIFGKTFFDAMDFLVSNLLMPFGALYLSLFTGYIFKKALAMEELHLDERAWKQGLFQVWLFLLRFFVSSFQSSSLWSSLPNLCNQKGLE

SEQ ID NO: 111 - protein, 186 aa, Streptococcus pneumoniae
MLKKWQLKDVILLAFLSIFFGGVFVGSGYVYNILSLLLTPLGLQAFANEILFGLWCMAAPIAAIFVPRVGSATIGEVLAALAEVLYGSQFGLGALLSGFVQGLGSEFGFIVTKNRYESWLSLTANSIGITLVSFVYEYIKLGYYAFSLPFVLSLLVVRFISVYFFCTILVRAIVKLYHQFATGGKA

SEQ ID NO: 112 - protein, 216 aa, Streptococcus pneumoniae
MVKVATQTPIISLFLLILSLETSFIPSIALTLSVVAFCILFMLYYRRFKMLAWMIILAILPSFANYWAVQLHGDASQAVMLGTRAFVTVCIGLVFVSSVSLKELLLYLAQKGLSRSWSYALIVVFNSFPLIQQEIKSLKEACLLRGQELHFWSPLIYSKVLMTVFRWRHLYLRALSAHGYDEHAQLKNSYRTFYIPKKTKLIYLLFFLLLQTSLFL

SEQ ID NO: 113 - protein, 174 aa, Streptococcus pneumoniae
MRKHQLQVHKLTILSMMIALDVVLTPIFRIEGMAPMSSVVNILAGIMMGPVYALAMATVTAFIRMTTQGIPPLALTGATFGALLAGLFYKYGRKFHYSALGEILGTGIIGSIVSYPVMVLFTGSAAKLSWFIYTPRFFGATLIGTAISFIAFRFLIKQEFFKKVQGYFFSERID

SEQ ID NO: 114 - protein, 267 aa, Streptococcus pneumoniae
MQEFTNPFPIGSSSLIHCITNEISCEMLANGILALGCKPVMADDSREVLDFTKQSQALFINLGHLSAEKEKAIRMAASYANQSSLPMVVDAVGVTTSSIRKSLVKDLLDYRPTVLKGNMSEIRSLVGLKHHGVGVDASAKDQETEDLLQVLKDWCQTYPGMSFLVTGPKDLVVSKNQVAVLGNGCTELDWITGTGDLVGALTAVFLSQGKTGFEASCLAVSYLNIAAEKIVVQGMGLEEFRYQVLNQLSLLRRDENWLDTIKGEVYE

SEQ ID NO: 115 - protein, 277 aa, Streptococcus pneumoniae
MNHKIAILSDVHGNATALEAVIADAKNQGASEYWLLGDIFLPGPGANDLVALLKDLPITASVRGNWDDRVLEALDGQYGLEDPQEVQLLRMTQYLMERMDPATIVWLRSLPLLEKKEIDGLRFSISHNLPDKNYGGDLLVENDTEKFDQLLDAETDVAVYGHVHKQLLRYGSQGQQIINPGSIGMPYFNWEALKNHRSQYAVIEVEDGELLNIQFRKVAYDYEAELELAKSKGLPFIEMYEELRRDDNYQGHNLELLASLIEKHGYVEDVKNFFDFL

SEQ ID NO: 116 - protein, 241 aa, Streptococcus pneumoniae
MNVNQIVRIIPTLKANNRKLNETFYIETLGMKALLEESAFLSLGDQTGLEKLVLEEAPSMRTRKVEGRKKLARLIVKVENPLEIEGILSKTDSIHRLYKGQNGYAFEIFSPEDDLILIHAEDDIASLVEVGEKPEFQTDLASISLSKFEISMELHLPTDIESFLESSEIGASLDFIPAQGQDLTVDNTVTWDLSMLKFLVNELDIASLRQKFESTEYFIPKSEKFFLGKDRNNVELWFEEV

SEQ ID NO: 117 - protein, 311 aa, Streptococcus pneumoniae
MKWTKIIKKIEEQIEAGIYPGASFAYFKDNQWTEFYLGQSDPEHGLQTEAGLVYDLASVSKVVGVGTVCTFLWEIGQLDIDRLVIDFLPESDYPDITIRQLLTHATDLDPFIPNRDLLTAPELKEAMFHLNRRSQPAFLYSDVHFLLLGFILERIFNQDLDVILKDQVWKPWGMTETKFGPVELAVPTVRGVEAGIVHDPKARLLGRHAGSAGLFSTIKDLQIFLEHYLADDFARDLNQNFSPLDDKERSLAWNLEGDWLDHTGYTGTFIMWNRQKQEATIFLSNRTYEKDERAQWILDRNQVMNLIRKEE

SEQ ID NO: 118 - protein, 160 aa, Streptococcus pneumoniae
MMKKTYNHILVWGVIFYSICIVCFCFTPQEQSTVGVGTPGIQHLGRLVFLLTPFNSLWKLGEVSDIGQLCWIFLQNILNVFLFFPLIFQLLYLFPNLRKTKKVLLFSFLVSLGIECTQLILDFFFDFNRVFEIDDLWTNTLGGYLAWLLYKRLHKNKVRN

SEQ ID NO: 119 - protein, 263 aa, Streptococcus pneumoniae
MKIPLLTFARHKFVYVLLTLLFLALVYRDVLMTYFFFDIHAPDLAKFDGQAIKNDLLKSALDFRILQFNLGFYQSFIIPIIIVLLGFQYIELKNKVLRLSIGREVSYQGLKRKLTLQVASIPCLIYLVTVLIIAIITYFFGTFSPLGWNSLFSDGSGLQRLLDGEIKSYLFFTCVLLIGIFINAIYFLQIVDYVGNVTRSAITYLMFLWLGSMLLYSALPYYMVPMTSLMQASYGDVSLMKLFTPYILYIVPYMVLEKYEDNV

SEQ ID NO: 120 - protein, 505 aa, Streptococcus pneumoniae
MFKVLQKVGKAFMLPIAILPAAGLLLGIGGALSNPTTIATYPILDNSIFQSIFQVMSSAGEVVFSNLSLLLCVGLCIGLAKRDKGTAALAGVTGYLVMTATIKALVKLFMAEGSAIDTGVIGALVVGIVAVYLHNRYNNIQLPSALGFFGGSRFVPIVTSFSSILIGFVFFVIWPPFQQLLVSTGGYISQAGPIGTFLYGFLMRLSGAVGLHHIIYPMFWYTELGGVETVAGQTVVGAQKIFFAQLADLAHSGLFTEGTRFFAGRFSTMMFGLPAACLAMYHSVPKNRRKKYAGLFFGVALTSFITGITEPIEFMFLFVSPVLYVVHAFLDGVSFFIADVLNISIGNTFSGGVIDFTLFGILQGNAKTNWVLQIPFGLIWSVLYYIIFRWFITQFNVLTPGRGEEVDSKEISESADSTSNTADYLKQDSLQIIRALGGSNNIEDVDACVTRLRVAVKEVNQVDKALLKQIGAVDVLEVKGGIQAIYGAKAILYKNSINEILGVDD

SEQ ID NO: 121 - protein, 442 aa, Streptococcus pneumoniae
MKFRKLACTVLAGAAVLGLAACGNSGGSKDAAKSGGDGAKTEITWWAFPVFTQEKTGDGVGTYEKSIIEAFEKANPDIKVKLETIDFKSGPEKITTAIEAGTAPDVLFDAPGRIIQYGKNGKLAELNDLFTDEFVKDVNNENIVQASKAGDKAYMYPISSAPFYMAMNKKMLEDAGVANLVKEGWTTDDFEKVLKALKDKGYTPGSLFSSGQGGDQGTRAFISNLYSGSVTDEKVSKYTTDDPKFVKGLEKATSWIKDNLINNGSQFDGGADIQNFANGQTSYTILWAPAQNGIQAKLLEASKVEVVEVPFPSDEGKPALEYLVNGFAVFNNKDDKKVAASKKFIQFIADDKEWGPKDVVRTGAFPVRTSFGKLYEDKRMETISGWTQYYSPYYNTIDGFAEMRTLWFPMLQSVSNGDEKPADALKAFTEKANETIKKAMKQ

SEQ ID NO: 122 - protein, 279 aa, Streptococcus pneumoniae
MQSTEKKPLTAFTVISTIILLLLTVLFIFPFYWILTGAFKSQPDTIVIPPQWFPKMPTMENFQQLMVQNPALQWMWNSVFISLVTMFLVCATSSLAGYVLAKKRFYGQRILFAIFIAAMALPKQVVLVPLVRIVNFMGIHDTLWAVILPLIGWPFGVFLMKQFSENIPTELLESAKIDGCGEIRTFWSVAFPIVKPGFAALAIFTFINTWNDYFMQLVMLTSRNNLTISLGVATMQAEMATNYGLIMAGAALAAVPIVTVFLVFQKSFTQGITMGAVKG

SEQ ID NO: 123 - protein, 216 aa, Streptococcus pneumoniae
MKIMFKNFNNILLNRKIVLLLRIVLMMILINHLLSTAVQKQDAVIFFKRELISIFSYNDYSEANLEIPKLLLNLSLFMVGWLSVILLESDLADHYHHLIRYQSSSFFDYTRKRLVVISKFFTQDLFVWFLGLLPLGIHFKTVALFFLLAQLMMLYLLLSYLIALISAGAGFSFFLYFLAFVGQEWMMDHIVTVYLVLLSLLVMLIVSRLEEKFKKG

SEQ ID NO: 124 - protein, 174 aa, Streptococcus pneumoniae
MGKGEMGKGVIGLEFDSEVLVNKAPTLQLANGKTATFLTQYDSKTLLFAVDKEDIGQEIIGIAKGSIESMHNLPVNLAGARVPGGVNGSKAAVHEVPEFTGGVNGTEPAVHEIAEYKGSDSLVTLTTKKDYTYKAPLAQQALPETGNKESDLLASLGLTAFFLGLFTLGKKREQ

SEQ ID NO: 125 - protein, 629 aa, Streptococcus pneumoniae
MKKTFFLLVLGLFCLLPLSVFAIDFKINSYQGDLYIHADNTAEFRQKIVYQFEEDFKGQIVGLGRAGKMPSGFDIDPHPKIQAAKNGAELADVTSEVTEEADGYTVRVYNPGQEGDIVEVDLVWNLKNLLFLYDDIAELNWQPLTDSSESIEKFEFHVRGDKGAEKLFFHTGKLFREGTIEKSNLDYTIRLDNLPAKRGVELHAYWPRTDFASARDQGLKGNRLEEFNKIEDSIVREKDQSKQLVTWVLPSILSISLLLSVCFYFIYRRKTTPSVKYAKNHRLYEPPMELEPMVLSEAVYSTSLEEVSPLVKGAGKFTFDQLIQATLLDVIDRGNVSIISEGDAVGLRLVKEDGLSSFEKDCLNLAFSGKKEETLSNLFADYKVSDSLYRRAKVSDEKRIQARGLQLKSSFEEVLNQMQEGVRKRVSFWGLPDYYRPLTGGEKALQVGMGALTILPLFIGFGLFLYSLDVHGYLYLPLPILGFLGLVLSVFYYWKLRLDNRDGVLNEAGAEVYYLWTSFENMLREIARLDQAELESIVVWNRLLVYATLFGYADKVSHLMKVHQIQVENPDINLYVAYGWHSTFYHSTAQMSHYASVANTASTYSVSSGSGSSGGGFSGGGGGGSIGAF

SEQ ID NO: 126 - protein, 886 aa, Streptococcus pneumoniae
MKKVRKIFQKAVAGLCCISQLTAFSSIVALAETPETSPAIGKVVIKETGEGGALLGDAVFELKNNTDGTTVSQRTEAQTGEAIFSNIKPGTYTLTEAQPPVGYKPSTKQWTVEVEKNGRTTVQGEQVENREEALSDQYPQTGTYPDVQTPYQIIKVDGSEKNGQHKALNPNPYERVIPEGTLSKRIYQVNNLDDNQYGIELTVSGKTVYEQKDKSVPLDVVILLDNSNSMSNIRNKNARRAERAGEATRSLIDKITSDSENRVALVTYASTIFDGTEFTVEKGVADKNGKRLNDSLFWNYDQTSFTTNTKDYSYLKLTNDKNDIVELKNKVPTEAEDHDGNRLMYQFGATFTQKALMKADEILTQQARQNSQKVIFHITDGVPTMSYPINFNHATFAPSYQNQLNAFFSKSPNKDGILLSDFITQATSGEHTIVRGDGQSYQMFTDKTVYEKGAPAAFPVKPEKYSEMKAAGYAVIGDPINGGYIWLNWRESILAYPFNSNTAKITNHGDPTRWYYNGNIAPDGYDVFTVGIGINGDPGTDEATATSFMQSISSKPENYTNVTDTTKILEQLNRYFHTIVTEKKSIENGTITDPMGELIDLQLGTDGRFDPADYTLTANDGSRLENGQAVGGPQNDGGLLKNAKVLYDTTEKRIRVTGLYLGTDEKVTLTYNVRLNDEFVSNKFYDTNGRTTLHPKEVEQNTVRDFPIPKIRDVRKYPEITISKEKKLGDIEFIKVNKNDKKPLRGAVFSLQKQHPDYPDIYGAIDQNGTYQNVRTGEDGKLTFKNLSDGKYRLFENSEPAGYKPVQNKPIVAFQIVNGEVRDVTSIVPQDIPAGYEFTNDKHYITNEPIPPKREYPRTGGIGMLPFYLIGCMMMGGVLLYTRKHP

SEQ ID NO: 127 - protein, 665 aa, Streptococcus pneumoniae
MKSINKFLTMLAALLLTASSLFSAATVFAAGTTTTSVTVHKLLATDGDMDKIANELETGNYAGNKVGVLPANAKEIAGVMFVWTNTNNEIIDENGQTLGVNIDPQTFKLSGAMPATAMKKLTEAEGAKFNTANLPAAKYKIYEIHSLSTYVGEDGATLTGSKAVPIEIELPLNDVVDAHVYPKNTEAKPKIDKDFKGKANPDTPRVDKDTPVNHQVGDVVEYEIVTKIPALANYATANWSDRMTEGLAFNKGTVKVTVDDVALEAGDYALTEVATGFDLKLTDAGLAKVNDQNAEKTVKITYSATLNDKAIVEVPESNDVTFNYGNNPDHGNTPKPNKPNENGDLTLTKTWVDATGAPIPAGAEATFDLVNAQTGKVVQTVTLTTDKNTVTVNGLDKNTEYKFVERSIKGYSADYQEITTAGEIAVKNWKDENPKPLDPTEPKVVTYGKKFVKVNDKDNRLAGAEFVIANADNAGQYLARKADKVSQEEKQLVVTTKDALDRAVAAYNALTAQQQTQQEKEKVDKAQAAYNAAVIAANNAFEWVADKDNENVVKLVSDAQGRFEITGLLAGTYYLEETKQPAGYALLTSRQKFEVTATSYSATGQGIEYTAGSGKDDATKVVNKKITIPQTGGIGTIIFAVAGAAIMGIAVYAYVKNNKDEDQLA

SEQ ID NO: 128 - protein, 390 aa, Streptococcus pneumoniae
MTMQKMQKMISRIFFVMALCFSLVWGAHAVQAQEDHTLVLQLENYQEVVSQLPSRDGHRLQVWKLDDSYSYDDRVQIVRDLHSWDENKLSSFKKTSFEMTFLENQIEVSHIPNGLYYVRSIIQTDAVSYPAEFLFEMTDQTVEPLVIVAKKTDTMTTKVKLIKVDQDHNRLEGVGFKLVSVARDVSEKEVPLIGEYRYSSSGQVGRTLYTDKNGEIFVTNLPLGNYRFKEVEPLAGYAVTTLDTDVQLVDHQLVTITVVNQKLPRGNVDFMKVDGRTNTSLQGAMFKVMKEESGHYTPVLQNGKEVVVTSGKDGRFRVEGLEYGTYYLWELQAPTGYVQLTSPVSFTIGKDTRKELVTVVKNNKRPRIDVPDTGEETLVYLDACCHFVVW

SEQ ID NO: 129 - protein, 521 aa, Streptococcus pneumoniae
MSHIYLSIFTSLLLMLGLVNVAQADEYLRIGMEAAYAPFNWTQDDDSNGAVKIDGTNQYANGYDVQIAKKIAKDLGKEPLVVKTKWEGLVPALTSGKIDMIIAGMSPTAERKQEIAFSSSYYTSEPVLLVKKDSAYASAKSLDDFNGAKITSQQGVYLYNLIAQIPGAKKETAMGDFAQMRQALEAGVIDAYVSERPEALTAEAANSKFKMIQVEPGFKTGEEDTAIAIGLRKNDNRISQINASIETISKDDQVALMDRMIKEQPAEATTTEETSSSFFSQVAKILSENWQQLLRGAGITLLISIVGTIIGLIIGLAIGVFRTAPLSENKVIYGLQKLVGWVLNVYIEIFRGTPMIVQSMVIYYGTAQAFGINLDRTLAAIFIVSINTGAYMTEIVRGGILAVDKGQFEAATALGMTHNQTMRKIVLPQVVRNILPATGNEFVINIKDTSVLNVISVVELYFSGNTVATQTYQYFQTFTIIAVIYFVLTFTVTRILRFIERRMDMDTYTTGANQMQTEDLK

SEQ ID NO: 130 - protein, 246 aa, Streptococcus pneumoniae
MTQAILEIKHLKKSYGQNEVLKDISLTVHKGEVISIIGSSGSGKSTFLRSINLLETPTDGQILYHGQNVLEKGYDLTQYREKLGMVFQSFNLFENLNVLENTIVAQTTVLKRERTEAEKIAKENLEKVGMGERYWQAKPKQLSGGQKQRVAIARALSMNPDAILFDEPTSALDPEMVGEVLKIMQDLAQEGLTMIVVTHEMEFARDVSHRVIFMDKGVIAEEGKPEDLFTNPKEDRTKEFLQRYLK

SEQ ID NO: 131 - protein, 229 aa, Streptococcus pneumoniae
MKKYQLLFKISAVFSYLFFVFSLSQLTLIVQNYWQFSSQIGNLFWIQNILSLLFIGVMIVVLVKTGHGYLFRIPRKKWLWYSILTVLVLVFQISFNVQTAKHVQSTAEGWAVLIGYSGTNFAELGIYIALFFLVPLMEELIYRGLLQHAFFKHSRFGLDLLLPSILFALPHFSSLPSLLDIFVFATVGIIFAGLTRYTKSIYPSYAVHVINNIVATFPFLLTFLHRVLG

SEQ ID NO: 132 - protein, 350 aa, Streptococcus pneumoniae
MNKKQWLGLGLVAVAAVGLAACGNRSSRNAASSSDVKTKAAIVTDTGGVDDKSFNQSAWEGLQAWGKEHNLSKDNGFTYFQSTSEADYANNLQQAAGSYNLIFGVGFALNNAVKDAAKEHTDLNYVLIDDVIKDQKNVASVTFADNESGYLAGVAAAKTTKTKQVGFVGGIESEVISRFEAGFKAGVASVDPSIKVQVDYAGSFGDAAKGKTIAAAQYAAGADIVYQVAGGTGAGVFAEAKSLNESRPENEKVWVIGVDRDQEAEGKYTSKDGKESNFVLVSTLKQVGTTVKDISNKAERGEFPGGQVIVYSLKDKGVDLAVTNLSEEGKKAVEDAKAKILDGSVKVPEK

SEQ ID NO: 133 - protein, 352 aa, Streptococcus pneumoniae
MSKKLQQISVPLISVFLGILLGAIVMWIFGYDAIWGYEELFYTAFGSLRGIGEIFRAMGPLVLIGLGFAVASRAGFFNVGLPGQALAGWILSGWFALSHPDMPRPLMILATIVIALIAGGIVGAIPGILRAYLGTSEVIVTIMMNYIVLYVGNAFIHAFPKDFMQSTDSTIRVGANATYQTPWLAELTGNSRMNIGIFFAIIAVAVIWFMLKKTTLGFEIRAVGLNPHASEYAGISAKRTIILSMIISGALAGLGGAVEGLGTFQNVYVQGSSLAIGFNGMAVSLLAANSPIGILFAAFLFGVLQVGAPGMNAAQVPSELVSIVTASIIFFVSVHYLIERFVKPKKQVKGGK

SEQ ID NO: 134 - protein, 276 aa, Streptococcus pneumoniae
MGVKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 135 - protein, 264 aa, Streptococcus pneumoniae
MVIDPFAINELDYYLVSHFHSDHIDPYTAAAILNNPKLEHVKFIGPYHCGRIWEGWGVPKERIIVVKPGDTIELKDMKIHAVESFDRTCLVTLPVNGADETGGELAGLAVTDEEMAQKAVNYIFETPGGTIYHGADSHFSNYFAKHGKDFKIDVALNNYGENPVGIQDKMTSIDLLRMAENLRTKVIIPVHYDIWSNFMASTNEILELWKMRKDRLQYDFHPFIWEVGGKYTYPQDQHLVEYHHPRGFDDCFEQDSNIQFKALL

SEQ ID NO: 136 - protein, 194 aa, Streptococcus pneumoniae
MFLSGWLSSFANTYIHDLLGVLFPDSPFLNAFESAIAAPLVEEPLKLLSLVFVLALIPVRKLKSLFLLGIASGLGFQMIKDIGYIRTDLPEGFDFTISRILERIISGIASHWTFSGLAVVGVYLLYRAYKGQKVGKKQGLIFLGLALGTHFLFNSPFVELETELPLAIPVVTAIALYGFYHAYCFVEKHNELMT

SEQ ID NO: 137 - protein, 129 aa, Streptococcus pneumoniae
MKVEPRCDVLSRMSHFFIRILIMELQELVERSWAIRQAYHELEVKHHDSKWTVEEDLLALSNDIGNFQRLVMTKQGRYYDETPYTLEQKLSENIWWLLELSQRLDIDILTEMENFLSDKEKQLNVRTWK

SEQ ID NO: 138 - protein, 324 aa, Streptococcus pneumoniae
MLDWKQFFLAYLRSRSRLFIYLLSLAFLVLLFQFLFASLGIYFLYFFFLCCFVTILFFTWDILVETQVYRQELLYGEREAKSPLEIALAEKLEAREMELYQQRSKAERKLTDLLDYYTLWVHQIKTPIAASQLLVAEVVDRQLKQQLEQEIFKIDSYTNLVLQYLRLESFHDDLVLKQVQIEDLVKEIIRKYALFFIQKGLNVNLHDLDKEIVTDKKWLLVVIEQIISNSLKYTKEGGLEIYMDDQELCIKDTGIGIKNSDVLRVFERGFSGYNGRLTQQSSGLGLYLSKKISEELGHQIRIESEVGKGTTVRIQFAQVNLVLE

SEQ ID NO: 139 - protein, 195 aa, Streptococcus pneumoniae
MELNTHNAEILLSAANKSHYPQDELPEIALAGRSNVGKSSFINTMLNRKNLARTSGKPGKTQLLNFFNIDDKMRFVDVPGYGYARVSKKEREKWGCMIEEYLTTRENLRAVVSLVDLRHDPSADDVQMYEFLKYYEIPVIIVATKADKIPRGKWNKHESAIKKKLNFDPSDDFILFSSVSKAGMDEAWDAILEKL

SEQ ID NO: 140 - protein, 296 aa, Streptococcus pneumoniae
MTKKQLHLVIVTGMSGAGKTVAIQSFEDLGYFTIDNMPPALLPKFLQLVEIKEDNPKLALVVDMRSRSFFSEIQAVLDELENQDGLDFKILFLDAADKELVARYKETRRSHPLAADGRILDGIKLERELLAPLKNMSQNVVDTTELTPRELRKTLAEQFSDQEQAQSFRIEVMSFGFKYGIPIDADLVFDVRFLPNPYYLPELRNQTGVDEPVYDYVMNHPESEDFYQHLLALIEPILPSYQKEGKSVLTIAMGCTGGQHRSVAFAKRLAQDLSKNWSVNEGHRDKDRRKETVNRS

SEQ ID NO: 141 - protein, 325 aa, Streptococcus pneumoniae
MRKPKITVIGGGTGSPVILKSLREKDVEIAAIVTVADDGGSSGELRKNMQQLTPPGDLRNVLVAMSDMPKFYEKVFQYRFSEDAGAFAGHPLGNLIIAGLSEMQGSTYNAMQLLSKFFHTTGKIYPSSDHPLTLHAVFQDGTEVAGESHIVDHRGIIDNVYVTNALNDDTPLASRRVVQTILESDMIVLGPGSLFTSILPNIVIKEIGRALLETKAEIAYVCNIMTQRGETEHFTDSDHVEVLHRHLGRPFIDTVLVNIEKVPQEYMNSNRFDEYLVQVEHDFVGLCKQVSRVISSNFLRLENGGAFHDGDLIVDELMRIIQVKK

SEQ ID NO: 142 - protein, 392 aa, Streptococcus pneumoniae
MKNLIKLLIIRLIVNLADSVFYIVALWHVSNNYSSSMFLGIFIAVNYLPDLLLIFFGPVIDRVNPQKILIISILVQLAVAVIFLLLLNQISFWVIMSLVFISVMASSISYVIEDVLIPQVVEYDKIVFANSLFSISYKVLDSIFNSFASFLQVAVGFILLVKIDIGIFLLALFILLLLKFRTSNANIENFSFKYYKREVLQGTKFILNNKLLFKTSISLTLINFFYSFQTVVVPIFSIRYFDGPIFYGIFLTIAGLGGILGNMLAPIVIKYLKSNQIVGVFLFLNGSSWLVAIVIKDYTLSLILFFVCFMSKGVFNIIFNSLYQQIPPHQLLGRVNTTIDSIISFGMPIGSLVAGTLIDLNIELVLIAISIPYFLFSYIFYTDNGLKEFSIY

SEQ ID NO: 143 - protein, 225 aa, Streptococcus pneumoniae
MMSNKNKEILIFAILYTVLFMFDGVKLLASLMPSAIANYLVYVVLALYGSFLFKDRLIQQWKEIRKTKRKFFFGVLTGWLFLILMTVVFEFVSEMLKQFVGLDGQGLNQSNIQSTFQEQPLLIAVFACVIGPLVEELFFRQVLLHYLQERLSGLLSIILVGLVFALTHMHSLALSEWIGAVGYLGGGLAFSIIYVKEKENIYYPLLVHMLSNSLSLIILAISIVK

SEQ ID NO: 144 - protein, 385 aa, Streptococcus pneumoniae
LKKPIIEFKNVSKVFEDSNTKVLKDINFELEEGKFYTLLGASGSGKSTILNIIAGLLDATTGDIMLDGVRINDIPTNKRDVHTVFQSYALFPHMNVFENVAFPLRLRKIDKKEIEQRVAEVLKMVQLEGYEKRSIRKLSGGQRQRVAIARAIINQPRVVLLDEPLSALDLKLRTDMQYELRELQQRLGITFVFVTHDQEEALAMSDWIFVMNDGEIVQSGTPVDIYDEPINHFVATFIGESNILPGTMIEDYLVEFNGKRFEAVDGGMKPNEPVEVVIRPEDLRITLPEEGKLQVKVDTQLFRGVHYEIIAYDELGNEWMIHSTRKAIVGEEIGLDFEPEDIHIMRLNETEEEFDARIEEYVEIEEQEAGLINAIEEERDEENKL

SEQ ID NO: 145 - protein, 206 aa, Streptococcus pneumoniae
MKSMRILFLLALIQISLSSCFLWKECILSFKQSTAFFIGSMVFVSGICAGVNYLYTRKQEVHSVLASKKSVKLFYSMLLLINLLGAVLVLSDNLFIKNTLQQELVDFLLPSFFFLFGLDLLIFLPLKKYVRDFLAMLDRKKTVLVTILATLLFLRNPMTIVSLLIYIGLGLFFAAYLVPNSVKKEVSFYGHIFRDLVLVIVTLIFF

SEQ ID NO: 146 - protein, 338 aa, Streptococcus pneumoniae
MVKKIIGMVLALLSVTVVGVGVFAYTIYQQGTETLAKTYKKIGEETKVIEATEPLTILLMGVDTGNVERTETWVGRSDSMILMTVNPKTKKTTMMSLERDILTRIESGNGQAHEAKLNSAYADGGAELAIETIQKMMNIHIDRYVMVNMRGLQKLVDAVGGITVNNILGFPISISDQEEFNTISIGVGEQHIGGEEALVYARMRYQDPEGDYGRQKRQREVIQKVMEKALSLNSIGHYQEILKALSDNMQTNIDLSAKSIPNLLGYKDSFKTIETQQLQGEGEILQGVSYQIVSRAHMLEMQNLLRRSLGQEEVTQLETNAVLFEDLFGRAPVGDEDN

SEQ ID NO: 147 - protein, 331 aa, Streptococcus pneumoniae
MKKQAYVIIALTSFLFVFFFSHSLLEILDFDWSIFLHDVEKTEKFVFLLLVFSMSMTCLLALFWRGIEELSLRKMQANLKRLLAGQEVVQVADPDLDASFKSLSGKLNLLTEALQKAENQSLAQEEEIIEKERKRIARDLHDTVSQELFAAHMILSGISQQALKLDREKMQTQLQSVTAILETAQKDLRVLLLHLRPVELEQKSLIEGIQILLKELEDKSDLRVSLKQNMTKLPKKIEEHIFRILQELISNTLRHAQASCLDVYLYQTDVELQLKVVDNGIGFQLGSLDDLSYGLRNIKERVEDMAGTVQLLTAPKQGLAVDIRIPLLDKE

SEQ ID NO: 148 - protein, 288 aa, Streptococcus pneumoniae
MIVSIISQGFVWAILGLGIFMTFRILNFPDMTTEGSFPLGGAVAVTLITKGVNPFLATLVAVGAGCLAGMAAGLLYTKGKIPTLLSGILVMTSCHSIMLLIMGRANLGLLGTKQIQDVLPFDSDLNQLLTGLIFVSIVIALMLFFLDTKLGQAYIATGDNPDMARSFGIHTGRMELMGLVLSNGVIALAGALIAQQEGYADVSRGIGVIVVGLASLIIGEVIFKSLSLAERLVTIVVGSIAYQFLVWAVIALGFNTSYLRLYSALILAVCLMIPTFKQTILKGAKLSK

SEQ ID NO: 149 - protein, 355 aa, Streptococcus pneumoniae
MKKMKVWSTVLATGVALTTLAACSGGSNSTTASSSEEKADKSQELVIYSNSVSNGRGDWLTAKAKEAGFNIKMVDIAGAQLADRVIAEKNNAVADMVFGIGAVDSNKIRDQKLLVQYKPKWLDKIDQSLSDKDNYYNPVIVQPLVLIGAPDVKEMPKDWTELGSKYKGKYSISGLQGGTGRAILASILVRYLDDKGELGVSEKGWEVAKEYLKNAYTLQKGESSIVKMLDKEDPIQYGMMWGSGALVGQKEQNVVFKVMTPEIGVPFVTEQTMVLSTSKKQALAKEFIDWFGQSEIQVEYSKNFGSIPANKDALKDLPEDTKKFVDQVKPQNIDWEAVGKHLDEWVEKAELEYVQ

SEQ ID NO: 150 - protein, 336 aa, Streptococcus pneumoniae
MIKFDNIQIKYGDFVAIDNLNLDIHEGEFFTFLGPSGCGKSTTLRALVGFLDPSSGSIEVNGTDVTHLEPEKRGIGIVFQSYALFPTMTVFDNIAFGLKVKKVAPDVIKAKVSAVAAKIKISDQQLQRNVSELSGGQQQRVALARALVLEPKILCLDEPLSNLDAKLRVDLRKELKRLQKELGITTLYVTHDQEEALTLSDRIAVFNNGYIEQVGTPVEIYHNSQTEFVCDFIGDINVLTDETVHEVLLKNTSVFLEDKKGYIRLEKVRFNRETEQDFILKGTIIDVEFSGVTIHYTIKVSESQILNVTSIDSQAAIRSVGESVELFITPSDVLQF

SEQ ID NO: 151 - protein, 563 aa, Streptococcus pneumoniae
MRHKLNLKDWLIRLGLIWFLVTFIIYPNFDLVVNVFVKGGEFSLDAVHRVLKSQRALQSIMNSFKLAFSLIITVNVVGILCVLFTEYFDIKGAKILKLGYMTSLIYGGVVLATGYKFVYGPYGLITKFLQNVIPSLDPNWFIGYGAVLFIMTFSGTANHTLFLTNTIRSVDYHTIEAARNMGAKPFTVFRKVVLPTLIPTLFALTIMVFLSGLSAVAAPMIVGGKEFQTINPMIITFAGMGNSRDLAALLAIILGIATTILLTIMNKIEKGGNYISISKTKAPLKKQKIASKPWNIIAHIVAYGLFTVFMLPLIFIVLYSFTDPVAIQTGNLTLSNFTLENYRLFFSNSAAFSPFLVSFIYSIIAATTATILAVVFARVVRKHKSRFDFLFEYGALLPWLLPSTLLAVSLLFTFNQPQFLVLNQILVGSLVILLIAYIVVKIPFSYRMVRAILFSVDDEMEDAARSMGASPFYTMMKVIIPFILPVVLSVIALNFNSLLTDFDLSVFLYHPLAQPLGITIRSAGDETATSNAQALVFVYTIVLMIISGTVLYFTQRPGRKVRK

SEQ ID NO: 152 - protein, 443 aa, Streptococcus pneumoniae
MIKNPKLLTKSFLRSFAILGGVGLVIHIAIYLTFPFYYIQLEGEKFNESARVFTEYLKTKTSDEIPSLLQSYSKSLTISAHLKRDIVDKRLPLVHDLDIKDGKLSNYIVMLDMSVSTADGKQVTVQFVHGVDVYKEAKNILLLYLPYTFLVTIAFSFVFSYFYTKRLLNPLFYISEVTSKMQDLDDNIRFDESRKDEVGEVGKQINGMYEHLLKVIYELESRNEQIVKLQNQKVSFVRGASHELKTPLASLRIILENMQHNIGDYKDHPKYIAKSINKIDQMSHLLEEVLESSKFQEWTECRETLTVKPVLVDILSRYQELAHSIGVTIENQLTDATRVVMSLRALDKVLTNLISNAIKYSDKNGRVIISEQDGYLSIKNTCAPLSDQELEHLFDIFYHSQIVTDKDESSGLGLYIVNNILESYQMDYSFLPYEHGMEFKISL

SEQ ID NO: 153 - protein, 290 aa, Streptococcus pneumoniae
MDKIIKTISESGAFRAFVLDSTETVRTAQEKHQTQASSTVALGRTLIASQILAANEKGNTKLTVKVLGSSSLGAIITVADTKGNVKGYVQNPGVDIKKTATGEVLVGPFVGNGQFLVITDYGTGNPYNSITPLISGEIGEDLAFYLTESQQTPSAVGLNVLLDEEDKVKVAGGFLVQVLPGAKKEEIARFEKRIQEMPAISTLLESDDHIEALLKAIYGDEAYKRLSEEEIRFQCDCSHERFMNALASLPSSDLQEMKEEDHGAEITCQFCQTTYNFDEKDLEELIRDKS

SEQ ID NO: 154 - protein, 152 aa, Streptococcus pneumoniae
MKSITKKIKATLAGVAALFAVFAPSFVSAQESSTYTVKEGDTLSEIAETHNTTVEKLAENNHIDNIHLIYVDQELVIDGPVAPVATPAPATYAAPAAQDETVSAPVAETPVVSETVVSTVSGSEAEAKEWIAQKESGGSIQLQMDVISDVTN

SEQ ID NO: 155 - protein, 677 aa, Streptococcus pneumoniae
MNLGEFWYNKINKNRGRRLMKKVRFIFLALLFFLASPEGAMASDGTWQGKQYLKEDGSQAANEWVFDTHYQSWFYIKADANYAENEWLKQGDDYFYLKSGGYMAKSEWVEDKGAFYYLDQDGKMKRNAWVGTSYVGATGAKVIEDWVYDSQYDAWFYIKADGQHAEKEWLQIKGKDYYFKSGGYLLTSQWINQAYVNASGAKVQQGWLFDKQYQSWFYIKENGNYADKEWIFENGHYYYLKSGGYMAANEWIWDKESWFYLKFDGKMAEKEWVYDSHSQAWYYFKSGGYMTANEWIWDKESWFYLKSDGKIAEKEWVYDSHSQAWYYFKSGGYMTANEWIWDKESWFYLKSDGKIAEKEWVYDSHSQAWYYFKSGGYMAKNETVDGYQLGSDGKWLGGKTTNENAAYYQVVPVTANVYDSDGEKLSYISQGSVVWLDKDRKSDDKRLAITISGLSGYMKTEDLQALDASKDFIPYYESDGHRFYHYVAQNASIPVASHLSDMEVGKKYYSADGLHFDGFKLENPFLFKDLTEATNYSAEELDKVFSLLNINNSLLENKGATFKEAEEHYHINALYLLAHSALESNWGRSKIAKDKNNFFGITAYDTTPYLSAKTFDDVDKGILGATKWIKENYIDRGRTFLGNKASGMNVEYASDPYWGEKIASVMMKINEKLGGKD

SEQ ID NO: 156 - protein, 309 aa, Streptococcus pneumoniae
MKKLGTLLVLFLSAIILVACASGKKDTTSGQKLKVVATNSIIADITKNIAGDKIDLHSIVPIGQDPHEYEPLPEDVKKTSEANLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 157 - protein, 419 aa, Streptococcus pneumoniae
MEWYKKIGLLATTGLALFGLGACSNYGKSADGTVTIEYFNQKKEMTKTLEEITRDFEKENPKIKVKVVNVPNAGEVLKTRVLAGDVPDVVNIYPQSIELQEWAKAGVFEDLSNKDYLKRVKNGYAEKYAVNEKVYNVPFTANAYGIYYNKDKFEELGLKVPETWDEFEQLVKDIVAKGQTPFGIAGADAWTLNGYNQLAFATATGGGKEANQYLRYSQPNAIKLSDPIMKDDIKVMDILRINGSKQKNWEGAGYTDVIGAFARGDVLMTPNGSWAITAINEQKPNFKIGTFMIPGKEKGQSLTVGAGDLAWSISATTKHPKEANAFVEYMTRPEVMQKYYDVDGSPTAIEGVKQAGEDSPLAGMTEYAFTDRHLVWLQQYWTSEADFHTLTMNYVLTGDKQGMVNDLNAFFNPMKADVD

SEQ ID NO: 158 - protein, 559 aa, Streptococcus pneumoniae
MKKIKPHGPLPSQTQLAYLGDELAAFIHFGPNTFYDQEWGTGQEDPERFNPSQLDAREWVRVLKETGFKKLILVVKHHDGFVLYPTAHTDYSVKVSPWRRGKGDLLLEVSQAATEFDMDMGVYLSPWDAHSPLYHVDREADYNAYYLAQLKEILSNPNYGNAGKFAEVWMDGARGEGAQKVNYEFEKWFETIRDLQGDCLIFSTEGTSIRWIGNERGYAGDPLWQKVNPDKLGTEAELNYLQHGDPSGTIFSIGEADVSIRPGWFYHEDQDPKSLEELVEIYFHSVGRGTPLLLNIPPNQAGLFDAKDIERLYEFATYRNELYKEDLALGAEVSGPALSADFACRHLTDGLETSSWASDADLPIQLELDLGSPKTFDVIELREDLKLGQRIAAFHVQVEVDGVWQEFGSGHTVGYKRLLRGAVVEAQKIRVVITESQALPLLTKISLYKTPGLSKKEVVQELAFAEKSLAVAKGENAYFTVKRRECSGPLEAKISIQPGTGVHGVAYQDEIQVLAFQTGETEKSLTLPTLYFAGDKTLDFYLNLTVDGQLVDQLQVQVS

SEQ ID NO: 159 - protein, 227 aa, Streptococcus pneumoniae
MLERLKRIHYMFWISLIFMIFPILSVVTGWLSAWHLLIDILFVVAYLGVLTTKSQRLSWLYWGLMLTYVVGNTAFVAVNYIWFFFFLSNLLSYHFSVRSLKSLHVWTFLLAQVLVVGQLLIFQRIEVEFLFYLLVILTFVDLMTFGLVRIRIVEDLKEAQVKQNAQINLLLAENERSRIGQDLHDSLGHTFAMLSVKTDLALQLFQMEAYPQVEKELKEIHQISKDP

SEQ ID NO: 160 - protein, 370 aa, Streptococcus pneumoniae
MNDKLKIFLLLGVFFLAITGFYVLLIRNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 161 - protein, 338 aa, Streptococcus pneumoniae
MKKKWMYYAACSSNESADDSSSDKGDGGSLVVYSPNSEGLIGATIPAFEEKYGIKVELIQAGTGELFKKLESEKEVPVADVIFGGSYTQYTTHGELFENYTSKENDNVIKEYQNTTGYSTPYTLDGSVLIVNPDLTKGMNIEGYNDLFKPELKGKIATADPANSSSAFAQLTNMLQAQGGYKDDKAWSYVKDLFTLIDGKIGSSSSSVYKVVADGEMAVGLSYEDPAVKLLNDGANIKVVYPKEGTVFLPASAAIVKKSKNMENAKKFIDFIISQEVQDTLGTTTTNRPVRKNAKTSENMKPIDKIKTLTEDYDYVIKNKSDIVKKYNEVFTDIQSKQ

SEQ ID NO: 162 - protein, 363 aa, Streptococcus pneumoniae
MSEIKIINAKKIYHDVPVIENLNITIPKGSLFTLLGASGCGKTTLLRMIAGFNSIEGGEFYFDDTKINNMEPSKRNIGMVFQNYAIFPHLTVRDNVAFGLMQKKVPKEELIQQTNKYLELMQIAQYADRKPDKLSGGQQQRVTLACALAVNPSVLLMDEPLSNLEAKLRLDMRQAIREIQHEVGITTVYVTHDQEEAMAISDQIAVMKDGVIQQIGRPKELYHKPANEFVATFIGRTNIIPANLEKRSDGAYIVFSDGYALRMPALDQVEEQAIHVSIRPEEFIKDESGDIEGTIRDSVYLGLNTDYFIETGFASKIQVSEESTFEEDLQKGNRIRLRINTQKLNIFSADGSQNLIKGVNHGT

SEQ ID NO: 163 - protein, 313 aa, Streptococcus pneumoniae
MKKKLLAGAITLLSVATLAACSKGSEGADLISMKGDVITEHQFYEQVKSNPSAQQVLLNMTIQKVFEKQYGSELDDKEVDDTIAEEKKQYGENYQRVLSQAGMTLETRKAQIRTSKLVELAVKKVAEAELTDEAYKKAFDEYTPDVTAQIIRLNNEDKAKEVLEKAKAEGADFAQLAKDNSTDEKTKENGGEITFDSASTEVPEQVKKAAFALDVDGVSDVITATGTQAYSSQYYIVKLTKKTEKSSNIDDYKEKLKTVILTQKQNDSTFVQSIIGKELQAANIKVKDQAFQNIFTQYIGGGDSSSSSSTSNE

SEQ ID NO: 164 - protein, 465 aa, Streptococcus pneumoniae
MKKNIKQYVTLGTVVVLSAFVANSVAAQETETSEVSTPKLVQPVAPTTPISEVQPTSDNSSEVTVQPRTVETTVKDPSSTAEETPVLEKNNVTLTGGGENVTKELKDKFTSGDFTVVIKYNQSSEKGLQALFGISNSKPGQQNSYVDVFLRDNGELGMEARDTSSNKNNLVSRPASVWGKYKQEAVTNTVAVVADSVKKTYSLYANGTKVVEKKVDNFLNIKDIKGIDYYMLGGVKRAGKTAFGFNGTLENIKFFNSALDEETVKKMTTNAVTGHLIYTANDTTGSNYFRIPVLYTFSNGRVFSSIDARYGGTHDFLNKINIATSYSDDNGKTWTKPKLTLAFDDFAPVPLEWPREVGGRDLQISGGATYIDSVIVEKKNKQVLMFADVMPAGVSFREATRKDSGYKQIDGNYYLKLRKQGDTDYNYTIRENGTVYDDRTNRPTEFSVDKNFGIKQNGNYLTVER

SEQ ID NO: 165 - protein, 266 aa, Streptococcus pneumoniae
MKKFSLLLAILPFLVACENQATPKETSAQKTIVLATAGDVPPFDYEDKGNLTGFDIEVLKAVDEKLSDYEIQFQRTAWESIFPGLDSGHYQAAANNLSYTKERAEKYLYSLPISNNPLVLVSNKKNPLTSLDQIAGKTTQEDTGTSNAQFINNWNQKHTDNPATINFSGEDIGKRILDLANGEFDFLVFDKVSVQKIIKDRGLDLSVVDLPSADSPSNYIIFSSDQKEFKEQFDKALKELYQDGTLEKLSNTYLGGSYLPDQSQLQ

SEQ ID NO: 166 - protein, 259 aa, Streptococcus pneumoniae
MKKNSLYIISSLFFACVLFVYATATNFQNSTSARQVKTETYTNTVTNVPIDIRYNSDKYFISGFASEVSVVLTGANRLSLASEMQESTRKFKVTADLTDAGVGTIEVPLSIEDLPNGLTAVATPQKITVKIGKKAQKDKVKIVPEIDPSQIDSRVQIENVMVSDKEVSITSDQETLDRIDKIIAVLPTSERITGNYSGSVPLQAIDRNGVVLPAVITPFDTIMKVTTKPVAPSSSTSNSSTSSSSETSSSTKATSSKTN

SEQ ID NO: 167 - protein, 263 aa, Streptococcus pneumoniae
MLIGEGYRTFPVLIYTQFISEVGGNSAFAIMAIIIALAIFLIQKHIANRYSFSMNLLHPIEPKKTTKGKMAAIYATVYGIIFISVLPQIYLIYTSFLKTSGMVSVKGYSPNSYKVAFHRMGSAIFNTIRIPLIALVLVVLFATFISYLAVRKRNLFTNLIDSLSMVPYIVPGTVLGIAFISSFNTGLFGSGFLMITGTAFILIMSLSARRLPYTIRSSVASLQQIAPSIEEAAESLGSSRLNTFAKITTPMMLSGIISGAILS

SEQ ID NO: 168 - DNA, 1332 bp, Streptococcus pneumoniae
atgataaaaaatcctaaattattaaccaagtcttttttaagaagttttgcaattctaggtggtgttggtctagtcattcatatagctatttatttgacctttcctttttattatattcaactggagggggaaaagtttaatgagagcgcaagagtgtttacggagtatttaaagactaagacatctgatgaaattccaagcttactccagtcttattcaaagtccttgaccatatctgctcaccttaaaagagatattgtagataagcggctccctcttgtgcatgacttggatattaaagatggaaagctatcaaattatatcgtgatgttagatatgtctgttagtacagcagatggtaaacaggtaaccgtgcaatttgttcacggggtggatgtctacaaagaagcaaagaatattttgcttttgtatctcccatatacatttttggttacaattgctttttcctttgttttttcttatttttatactaaacgcttgctcaatcctcttttttacatttcagaagtgactagtaaaatgcaagatttggatgacaatattcgttttgatgaaagtaggaaagatgaagttggtgaagttggaaaacagattaatggtatgtatgagcacttgttgaaggttatttatgagttggaaagtcgtaatgagcaaattgtaaaattgcaaaatcaaaaggtttcctttgtccgcggagcatcacatgagttgaaaacccctttagccagtcttagaattatcctagagaatatgcagcataatattggagattacaaagatcatccaaaatatattgcaaagagtataaataagattgaccagatgagccacttattagaagaagtactggagtcttctaaattccaagagtggacagagtgtcgtgagaccttgactgttaagccagttttagtagatattttatcacgttatcaagaattagctcattcaataggtgttacaattgaaaatcaattgacagatgctaccagggtcgtcatgagtcttagggcattggataaggttttgacaaacctgattagtaatgcaattaaatattcagataaaaatgggcgtgtaatcatatccgagcaagatggctatctctctatcaaaaatacatgtgcgcctctaagtgaccaagaactagaacatttatttgatatattctatcattctcaaatcgtgacagataaggatgaaagttccggtttgggtctttacattgtgaataatattttagaaagctatcaaatggattatagttttctcccttatgaacacggtatggaatttaagattagcttgtag

SEQ ID NO: 169 - DNA, 873 bp, Streptococcus pneumoniae
atggataaaattattaaaactatatcagaaagcggagcctttcgtgcttttgtccttgatagcactgaaaccgtccgcactgctcaagaaaaacatcaaacccaagctagctcaactgtagcgcttggtcgaactcttatcgctagccagattctcgcagccaatgaaaaaggaaataccaaacttacagttaaggtgttgggatctagctctctaggtgctattatcaccgtcgctgataccaaggggaacgtcaaaggctatgttcaaaatcctggtgttgacatcaaaaagactgcgactggtgaagtcctagtcggaccttttgttggaaatggtcaattcctcgttatcacagactacggtactggaaatccttacaactctataactcccctcatctctggagaaatcggtgaagaccttgccttttaccttactgaaagccaacaaacgccttcagcggtcggcctcaatgtccttttggacgaggaagacaaggtcaaggttgcaggtggtttcctagttcaagtcttgccaggagccaagaaagaagagattgctcgctttgaaaaacgcatccaagaaatgccagctatctctactcttctcgaaagcgacgaccatatcgaagccctcctcaaggctatctacggggacgaagcctacaagcgtctttctgaagaagaaatccgtttccaatgtgactgtagccatgaacgctttatgaacgctcttgccagccttccaagctcagacttacaggaaatgaaagaggaagaccacggggcagaaatcacttgtcaattctgccaaactacttacaactttgatgaaaaggacctggaggaactcattcgtgacaaatcttaa

SEQ ID NO: 170 - DNA, 459 bp, Streptococcus pneumoniae
atgaaatcaataactaaaaagattaaagcaactcttgcaggagtagctgccttgtttgcagtatttgctccatcatttgtatctgctcaagaatcatcaacttacactgttaaagaaggtgatacactttcagaaatcgctgaaactcacaacacaacagttgaaaaattggcagaaaacaaccacattgataacattcatttgatttatgttgatcaagagttggttatcgatggccctgtagcgcctgttgcaacaccagcgccagctacttatgcggcaccagccgctcaagatgaaactgtttcagctccagtagcagaaactccagtagtaagtgaaacagttgtttcaactgtaagcggatctgaagcagaagccaaagaatggatcgctcaaaaagaatcaggtggtagtatacagctacaaatggacgttatatcggacgttaccaattaa

SEQ ID NO: 171 - DNA, 2034 bp, Streptococcus pneumoniae
atgaatttaggagaattttggtacaataaaataaataagaacagaggaagaaggttaatgaagaaagtaagatttatttttttagctctgctatttttcttagctagtccagagggtgcaatggctagtgatggtacttggcaaggaaaacagtatctgaaagaagatggcagtcaagcagcaaatgagtgggtttttgatactcattatcaatcttggttctatataaaagcagatgctaactatgctgaaaatgaatggctaaagcaaggtgacgactatttttacctcaaatctggtggctatatggccaaatcagaatgggtagaagacaagggagccttttattatcttgaccaagatggaaagatgaaaagaaatgcttgggtaggaacttcctatgttggtgcaacaggtgccaaagtaatagaagactgggtctatgattctcaatacgatgcttggttttatatcaaagcagatggacagcacgcagagaaagaatggctccaaattaaagggaaggactattatttcaaatccggtggttatctactgacaagtcagtggattaatcaagcttatgtgaatgctagtggtgccaaagtacagcaaggttggctttttgacaaacaataccaatcttggttttacatcaaagaaaatggaaactatgctgataaagaatggattttcgagaatggtcactattattatctaaaatccggtggctacatggcagccaatgaatggatttgggataaggaatcttggttttatctcaaatttgatgggaaaatggctgaaaaagaatgggtctacgattctcatagtcaagcttggtactacttcaaatccggtggttacatgacagccaatgaatggatttgggataaggaatcttggttttatctcaaatctgatgggaaaatagctgaaaaagaatgggtctacgattctcatagtcaagcttggtactacttcaaatccggtggttacatgacagccaatgaatggatttgggataaggaatcttggttttacctcaaatctgatgggaaaatagctgaaaaagaatgggtctacgattctcatagtcaagcttggtactacttcaaatctggtggctacatggcgaaaaatgagacagtagatggttatcagcttggaagcgatggtaaatggcttggaggaaaaactacaaatgaaaatgctgcttactatcaagtagtgcctgttacagccaatgtttatgattcagatggtgaaaagctttcctatatatcgcaaggtagtgtcgtatggctagataaggatagaaaaagtgatgacaagcgcttggctattactatttctggtttgtcaggctatatgaaaacagaagatttacaagcgctagatgctagtaaggactttatcccttattatgagagtgatggccaccgtttttatcactatgtggctcagaatgctagtatcccagtagcttctcatctttctgatatggaagtaggcaagaaatattattcggcagatggcctgcattttgatggttttaagcttgagaatcccttccttttcaaagatttaacagaggctacaaactacagtgctgaagaattggataaggtatttagtttgctaaacattaacaatagccttttggagaacaagggcgctacttttaaggaagccgaagaacattaccatatcaatgctctttatctccttgcccatagtgccctagaaagtaactggggaagaagtaaaattgccaaagataagaataatttctttggcattacagcctatgatacgaccccttacctttctgctaagacatttgatgatgtggataagggaattttaggtgcaaccaagtggattaaggaaaattatatcgataggggaagaactttccttggaaacaaggcttctggtatgaatgtggaatatgcttcagacccttattggggcgaaaaaattgctagtgtgatgatgaaaatcaatgagaagctaggtggcaaagattag

SEQ ID NO: 172 - DNA, 930 bp, Streptococcus pneumoniae
atgaaaaaattaggtacattactcgttctctttctttctgcaatcattcttgtagcatgtgctagcggaaaaaaagatacaacttctggtcaaaaactaaaagttgttgctacaaactcaatcatcgctgatattactaaaaatattgctggtgacaaaattgaccttcatagtatcgttccgattgggcaagacccacacgaatacgaaccacttcctgaagacgttaagaaaacttctgaggctaatttgattttctataacggtatcaaccttgaaacaggtggcaatgcttggtttacaaaattggtagaaaatgccaagaaaactgaaaacaaagactacttcgcagtcagcgacggcgttgatgttatctaccttgaaggtcaaaatgaaaaaggaaaagaagacccacacgcttggcttaaccttgaaaacggtattatttttgctaaaaatatcgccaaacaattgagcgccaaagaccctaacaataaagaattctatgaaaaaaatctcaaagaatatactgataagttagacaaacttgataaagaaagtaaggataaatttaataagatccctgctgaaaagaaactcattgtaaccagcgaaggagcattcaaatacttctctaaagcctatggtgtcccaagtgcttacatctgggaaatcaatactgaagaagaaggaactcctgaacaaatcaagaccttggttgaaaaacttcgccaaacaaaagttccatcactctttgtagaatcaagtgtggatgaccgtccaatgaaaactgtttctcaagacacaaacatcccaatctacgctcaaatctttactgactctatcgcagaacaaggtaaagaaggcgacagctactacagcatgatgaaatacaaccttgacaagattgctgaaggattggcaaaataa

SEQ ID NO: 173 - DNA, 1260 bp, Streptococcus pneumoniae
atggaatggtataaaaaaatcggacttcttgcaactacaggtttagctttgtttgggctcggcgcttgctccaactatggtaaatctgcggatggcacagtgaccatcgagtatttcaaccagaaaaaagaaatgaccaaaaccttggaagaaatcactcgtgattttgagaaggaaaaccctaagatcaaggtcaaagtcgtcaatgtaccaaatgctggtgaagtattgaagacacgcgttctcgcaggagatgtgcctgatgtggtcaatatttacccacagtccatcgaactgcaagaatgggcaaaagcaggtgtttttgaagatttgagcaacaaagactacctgaaacgcgtgaaaaatggctacgctgaaaaatatgctgtaaacgaaaaagtttacaacgttccttttacagctaatgcttatggaatttactacaacaaagataaattcgaagaactgggcttgaaggttcctgaaacctgggatgaatttgaacagttagtcaaagatatcgttgctaaaggacaaacaccatttggaattgcaggtgcagatgcttggacactcaatggttacaatcaattagcctttgcgacagcaacaggtggaggaaaagaagcaaatcaataccttcgttattctcaaccaaatgccattaaattgtcggatccgattatgaaagatgatatcaaggtcatggacatccttcgcatcaatggatctaagcaaaagaactgggaaggtgctggctataccgatgttatcggagccttcgcacgtggggatgtcctcatgacaccaaatgggtcttgggcgatcacagcgattaatgaacaaaaaccgaactttaagattgggaccttcatgattccaggaaaagaaaaaggacaaagcttaaccgttggtgcgggagacttggcatggtctatctcagccaccaccaaacatccaaaagaagccaatgcctttgtggaatatatgacccgtccagaagtcatgcaaaaatactacgatgtggacggatctccaacagcgatcgaaggggtcaaacaagcaggagaagattcaccgcttgctggtatgaccgaatatgcctttacggatcgtcacttggtctggttgcaacaatactggaccagtgaagcagacttccataccttgaccatgaactatgtcttgaccggtgataaacaaggcatggtcaatgatttgaatgccttctttaacccgatgaaagcggatgtggattag

SEQ ID NO: 174 - DNA, 1680 bp, Streptococcus pneumoniae
atgaagaaaatcaaaccgcatggaccgttaccaagtcagactcagctagcttatctgggagatgaactagcagcttttatccacttcggtcctaataccttttatgaccaagaatgggggactggacaggaggatcctgagcgctttaacccgagtcagttggatgcgcgtgagtgggttcgtgtgctcaaggaaacgggcttcaaaaagttgattttggtggtcaagcaccacgatggctttgtcctttatccgacagctcacacagattattcggttaaggtcagtccttggaggagaggaaagggcgacttgctccttgaagtatcccaagctgccacagagtttgatatggatatgggggtctacctgtcaccgtgggatgcccatagtcccctctatcatgtggaccgagaagcggactacaatgcctattatctggctcagttgaaggaaatcttatcaaatcctaactatgggaatgctggtaagttcgctgaggtttggatggatggtgccagaggagagggcgcgcaaaaggttaattatgaatttgaaaaatggtttgaaaccattcgtgacctgcagggcgattgcttgattttttcaacagaaggcaccagtatccgctggattggcaatgaacgagggtatgcaggtgatccactgtggcaaaaggtgaatcctgataaactaggaacagaagcagagctgaactatcttcagcacggggatccctcgggcacgattttttcaatcggagaggcagatgtttccatccgtccaggctggttctaccatgaggatcaggatcctaagtctctcgaggagttggtcgaaatctactttcactcagtagggcgaggaactccactcttgcttaatattccgccgaatcaagctgggctctttgatgcaaaggatattgaacgactttatgaatttgcgacctatcgcaatgagctctataaagaagatttggctctgggagctgaggtatctggtccagctctttccgcagactttgcttgtcgccatttgacagacggccttgagaccagctcttgggcaagcgatgcagacttgcccatccagttagaactcgacttaggttctcctaaaacttttgatgtaattgagttaagagaagatttgaagctagggcaacgaatcgctgcttttcatgtgcaagtagaggtggatggtgtctggcaggagtttggttcgggtcatactgttggttacaaacgtctcttacgaggagcagttgttgaggcacagaagatacgtgtagtcattacagaatcacaggctttgcctttgttgaccaagatttccctttataaaactcctggattatcaaaaaaagaagttgttcaggaactagcatttgcagaaaaaagcctagctgtggcaaagggagaaaatgcctattttacagttaagcgcagagaatgtagtggtcctttagaagctaagatttcgattcaaccggggacaggtgtccatggtgtcgcctatcaggatgagattcaagtccttgcgtttcaaactggtgagactgaaaaaagtctgacgctaccaaccttgtatttcgcaggagataaaaccttggatttctatctgaacctaacggtggatggtcagcttgtggatcaacttcaagtccaagtttcataa

SEQ ID NO: 175 - DNA, 684 bp, Streptococcus pneumoniae
atgcttgaaagactgaaaagaatacattatatgttttggatcagtttaatttttatgattttccccatcctgtctgtagtgactgggtggctttctgcctggcatttattgattgatattctatttgtagtggcatatttgggtgttttaacaactaagagccagcgcctatcttggctatattggggcctcatgctgacttatgtagttgggaatactgcctttgttgctgttaattatatctggtttttctttttcctatccaatctcttaagttatcatttcagcgtacgtagtttaaagtctttacatgtctggacttttcttcttgctcaagtccttgttgtggggcaactgttgatttttcagagaatcgaagttgagtttctattctatctacttgtaattcttacttttgtcgatttaatgacttttggattggttcggattcgtattgtcgaggatttgaaagaagctcaggtcaagcaaaatgctcagataaatctattgcttgctgaaaatgaacgtagtcgtatcggtcaggatttgcatgatagtctgggacatacctttgctatgctgagtgtcaagacagatttagccttgcagttatttcagatggaggcttatccacaggtggaaaaggaattaaaagaaattcaccagatcagcaaggatccatga

SEQ ID NO: 176 - DNA, 1113 bp, Streptococcus pneumoniae
atgaatgataagttaaaaatcttcttgttgctaggagtattttttctagccataaccggtttctatgttctattgatacgaaatgcagggcagacagatgcctcgcaaattgaaaaggcggcagttagccaaggaggaaaagcagtgaaaaaaacagaaattagtaaagacgcagacttgcacgaaatttatctagctggaggttgtttctggggagtggaggaatatttctcacgtgttcccggggtgacggatgccgtttcaggctatgcaaatggtagaggagaaacaaccaagtacgaattgattaaccaaacaggtcatgcagaaaccgtccatgtcacctatgatgccaagcaaatttctctcaaggaaatcctgcttcactatttccgcattatcaatccaaccagcaaaaataaacaaggaaatgatgtggggacccagtaccgtactggtgtttattacacagatgacaaggatttggaagtgattaaccaagtctttgatgaggtggctaagaaatacgatcaacctctagcagttgaaaaggaaaacttgaagaattttgtggtggctgaggattaccatcaagactatctcaagaaaaatccaaatggctactgccatatcaatgttaatcaggcggcctatcctgtcattgatgccagcaaatatccaaaaccaagtgatgaggaattgaaaaagaccctgtcacctgaggagtatgcagttacccaggaaaatcaaacagaacgagctttctcaaaccgttactgggataaatttgaatccggtatctatgtggatatagcaactggggaacctctcttttcatcaaaagacaaatttgagtctggttgtggctggcctagttttacccaacccatcagtccagatgttgtcacctacaaggaagataagtcctacaatatgacgcgtatggaagtgcggagccgagtaggagattctcaccttgggcatgtctttacggatggtccacaggacaagggcggcttacgttactgtatcaatagcctctctatccgctttattcccaaagaccaaatggaagaaaaaggctacgcttatttactagattatgttgattaa

SEQ ID NO: 177 - DNA, 1017 bp, Streptococcus pneumoniae
atgaaaaagaaatggatgtattatgctgcttgttcttctaatgaatctgccgatgacagttcatctgataaaggagacggcggttcgctagtcgtttattcaccaaactcagagggcttaattggagcaactattcctgcctttgaagaaaaatatggtatcaaagtagaactgattcaagctggtactggagaacttttcaaaaaactagagtcagaaaaagaagttcctgtagctgatgttatctttggtggttcttatacacaatatactacccacggagaactctttgaaaactatacttcaaaagaaaatgataatgttatcaaagaatatcaaaacacaactggctactctactccttatacactagatggtagtgttttaatcgtcaaccctgatttaactaaaggcatgaacatcgaaggatataacgatcttttcaaacctgaactaaaaggaaaaatcgcaactgctgacccagcaaactcttctagcgcctttgctcaattaacaaatatgctacaagctcaaggtggttacaaagatgataaggcttggtcttatgtaaaagatcttttcacacttattgatggtaaaatcggttcaagttcatctagtgtctataaagtagtcgctgatggagaaatggctgttggtctctcttatgaagatccagcagttaaactcttaaatgacggagctaacattaaggtagtctatccaaaagaaggaaccgtcttcctacctgctagtgctgctatcgttaaaaaatctaaaaatatggaaaatgccaagaaatttatcgattttattatctctcaagaagtacaagatacacttggtacaaccactactaaccgtcctgttcgtaaaaatgctaaaacaagcgaaaacatgaaaccaattgacaaaatcaaaacactcactgaagattatgattatgtcatcaagaataaatcagatatcgttaagaaatacaacgaagtctttacagatatccaatctaaacagtaa

SEQ ID NO: 178 - DNA, 1092 bp, Streptococcus pneumoniae
atgagtgagatcaaaattattaacgccaaaaaaatctaccacgatgtccctgttattgagaatttgaacattacaattccaaaaggaagtctctttacccttcttggagcttcaggatgtgggaaaacgacccttcttcgtatgattgcaggtttcaacagtatcgaaggtggagaattttacttcgatgatacaaaaatcaataatatggaacccagcaaacgcaatatcgggatggttttccaaaactacgctattttcccacatttgactgtccgagacaacgttgcttttggtcttatgcaaaagaaggttccaaaagaagaattgattcaacagaccaacaagtatcttgaactcatgcaaattgctcaatatgcggatcgaaagcccgataaactcagtggtggacaacaacaacgtgtcaccttggcatgcgccttagcggttaatccaagtgttctcctcatggacgagccacttagtaatctggaggccaaacttcgcttggatatgcgtcaagccatccgagaaatccaacacgaagtgggaattacaactgtttatgtaacccacgaccaagaagaagccatggctatttcagaccaaattgctgttatgaaagatggggtgatccaacaaatcggccgaccaaaagaactctatcataaaccagctaatgagtttgtggcaacctttatcggacgcacaaatattatccctgccaatcttgaaaaacggagcgacggcgcttatatcgtcttttcagatggctatgcccttcgaatgccagctcttgatcaggttgaggagcaagctattcatgtaagcattcgtcccgaagagtttatcaaagatgaatctggagatattgaaggaactattagagatagcgtctatcttggactaaatacggattatttcattgagacaggttttgcctcaaaaattcaagttagtgaagaatcaacttttgaagaagatctacaaaaaggcaatcgtattcgtctacgaatcaatacgcaaaaattaaacatcttttctgcagatggttcccaaaacctgataaaaggagtcaaccatggaacgtaa

SEQ ID NO: 179 - DNA, 942 bp, Streptococcus pneumoniae
atgaagaaaaaattattggcaggtgccatcacactattatcagtagcaactttagcagcttgttcgaaagggtcagaaggtgcagaccttatcagcatgaaaggggatgtcattacagaacatcaattttatgagcaagtgaaaagcaacccttcagcccaacaagtcttgttaaatatgaccatccaaaaagtttttgaaaaacaatatggctcagagcttgatgataaagaggttgatgatactattgccgaagaaaaaaaacaatatggcgaaaactaccaacgtgtcttgtcacaagcaggtatgactcttgaaacacgtaaagctcaaattcgtacaagtaaattagttgagttggcagttaagaaggtagcagaagctgaattgacagatgaagcctataagaaagcctttgatgagtacactccagatgtaacggctcaaatcatccgtcttaataatgaagataaggccaaagaagttctcgaaaaagccaaggcagaaggtgctgattttgctcaattagccaaagataattcaactgatgaaaaaacaaaagaaaatggtggagaaattacctttgattctgcttcaacagaagtacctgagcaagtcaaaaaagccgctttcgctttagatgtggatggtgtttctgatgtgattacagcaactggcacacaagcctacagtagccaatattacattgtaaaactcactaagaaaacagaaaaatcatctaatattgatgactacaaagaaaaattaaaaactgttatcttgactcaaaaacaaaatgattcaacatttgttcaaagcattatcggaaaagaattgcaagcagccaatatcaaggttaaggaccaagccttccaaaatatctttacccaatatatcggtggtggagattcaagctcaagcagtagtacatcaaacgaatag

SEQ ID NO: 180 - DNA, 1395 bp, Streptococcus pneumoniae
atgaaaaaaaatattaaacaatatgtaaccttaggtactgtagtggtattatcagcatttgttgctaactcagttgcagctcaggagactgaaacttctgaagtatcaacaccaaagttggtgcaacctgttgcaccaacgactccgatttcggaagtacaacctacatcggataactcttcggaagttactgtacaacctcgaacagttgaaactactgttaaggatccatcttctacagcggaagaaactcctgtcttagaaaaaaataatgttactttaacagggggcggagaaaatgttactaaagagttaaaggataaatttactagcggtgactttactgtagtgattaagtacaatcagtcaagtgagaaaggcttacaagctctgtttggaatatctaattccaaacccggtcaacaaaatagttatgtagatgtgttccttagagacaatggtgagttggggatggaagcgcgtgatacttcttccaataaaaataacctagtatccagacctgcttcagtttggggtaagtacaaacaagaggctgtgactaacactgttgcagtagtagcagattcagtcaaaaaaacatattctttatacgcaaatggtacaaaagtagtagaaaagaaagtggataatttcctaaacatcaaggatattaaaggtattgattactatatgcttgggggagtgaaacgtgcaggaaaaacggcgtttggttttaacggaacactagaaaatatcaaattctttaatagtgcattggatgaagaaactgttaaaaagatgacaacaaacgctgttactggacatttaatttatacggctaatgatacaacaggttctaactatttccgtattccagttctgtatacttttagcaatggtcgggtattttcaagcattgacgctcgttacggtggaactcatgatttcttgaataaaattaatattgctacaagttatagtgatgataatggtaagacatggactaaaccaaaattaacattggcattcgatgattttgcgccagtaccattagaatggcctcgtgaagttggtggacgtgacttacaaatcagcggtggtgcaacctatattgactctgttattgttgaaaaaaagaacaaacaagtactcatgtttgctgatgtgatgcctgctggagtaagttttagagaagcaactagaaaagattcaggttataaacaaattgatggtaattattaccttaaattaaggaaacaaggtgatactgattacaattatactattcgtgagaatggtactgtatacgacgatcgtaccaacagaccaactgaattttcagtagataaaaatttcggtattaaacaaaatggtaattatttgacggtagagcgg

SEQ ID NO: 181 - DNA, 801 bp, Streptococcus pneumoniae
atgaaaaaatttagcctattactagctatcctaccatttttggttgcctgtgagaatcaagctacacccaaagagactagcgctcaaaagacaatcgtccttgctacagctggcgacgtgccaccatttgactacgaagacaagggcaatctgacaggctttgatatcgaagttttaaaggcagtagatgaaaaactcagcgactacgagattcaattccaaagaaccgcctgggagagcatcttcccaggacttgattctggtcactatcaggctgcggccaataacttgagttacacaaaagagcgtgctgaaaaatacctttactcgcttccaatttccaacaatcccctcgtccttgtcagcaacaagaaaaatcctttgacttctcttgaccagatcgctggtaaaacaacacaagaggataccggaacttctaacgctcaattcatcaataactggaatcagaaacacactgataatcccgctacaattaatttttctggtgaggatattggtaaacgaatcctagaccttgctaacggagagtttgatttcctagtttttgacaaggtatccgttcaaaagattatcaaggaccgtggtttagacctctcagtcgttgatttaccttctgcagatagccccagcaattatatcattttctcaagcgaccaaaaagagtttaaagagcaatttgataaagcgctcaaagaactctatcaagacggaacccttgaaaaactcagcaatacctatctaggtggttcttacctcccagatcaatctcagttacaataa

SEQ ID NO: 182 - DNA, 780 bp, Streptococcus pneumoniae
atgaaaaaaaatagtttatatatcatatcctcactcttttttgcttgtgtcttatttgtctatgctacggcgacgaattttcaaaacagtaccagtgctaggcaggtaaaaacggaaacctatactaatacagtaacaaatgtccctattgacatacgctataatagtgataagtattttattagcggttttgcttcagaagtatcagtggtcttgactggtgcaaatcgcctatcgctagctagtgaaatgcaagaaagtacacgtaaattcaaggttactgctgacctaacagatgccggtgttggaacgattgaagttcctttgagcattgaagatttacccaatgggctgaccgctgtggcgactccgcaaaaaattacagtcaagattggtaagaaggctcagaaggataaggtaaagattgtaccagagattgaccctagtcaaattgatagtcgggtacaaattgaaaatgtcatggtgtcagataaagaagtgtctattacgagtgaccaagagacattggatagaattgataagattatcgctgttttgccaactagcgaacgtataacaggtaattacagtggttcagtacctttgcaggcaatcgaccgcaatggtgttgtcttaccggcagttatcactccgtttgatacaataatgaaggtgactacaaaaccagtagcaccaagttcaagcacatcaaattcaagtacaagcagttcatcggagacatcttcgtcaacgaaagcaactagttcaaaaacgaattaa

SEQ ID NO: 183 - DNA, 792 bp, Streptococcus pneumoniae
atgttgattggcgaagggtatcggactttccctgtcctgatttatacccaatttattagcgaggttggaggaaattctgcttttgcaattatggcgattatcattgccttggcaattttccttatccaaaaacacattgcaaaccgctacagtttcagcatgaatctgctccatccaattgagcctaaaaaaactacaaaaggaaaaatggctgccatttatgcaacagtctacggaattatctttatctctgttttacctcaaatctacttaatttatacctctttcctaaaaacatcaggtatggtatctgttaaaggttattctccaaacagttacaaggtagctttccatcgtatgggatctgctattttcaataccattcgtatccctttgattgccttagttctagttgttctatttgcgacatttatctcctacctagccgttagaaaacggaatttgtttacaaacttaattgacagcctcagtatggtaccttatattgtaccaggaaccgttctagggattgccttcatttcttccttcaatactggtctatttggaagtggatttcttatgattacagggactgctttcatcttgattatgtctctatctgccagaagattaccttatactattcgctcatctgttgctagcttacaacaaatagcaccaagtattgaagaagctgctgaaagcttaggaagtagtcgtctcaatacctttgctaagattacaactccaatgatgctatctggtatcatttctggagccatcttatcttga

SEQ ID NO: 184 - protein, 744 aa, Streptococcus pneumoniae
MNKKKMILTSLASVAILGAGFVTSQPTFVRAEESPQVVEKSSLEKKYEEAKAKADTAKKDYETAKKKAEDAQKKYEDDQKRTEEKARKEAEASQKLNDVALVVQNAYKEYREVQNQRSKYKSDAEYQKKLTEVDSKIEKARKEQQDLQNKFNEVRAVVVPEPNALAETKKKAEEAKAEEKVAKRKYDYATLKVALAKKEVEAKELEIEKLQYEISTLEQEVATAQHQVDNLKKLLAGADPDDGTEVIEAKLKKGEAELNAKQAELAKKQTELEKLLDSLDPEGKTQDELDKEAEEAELDKKADELQNKVADLEKEISNLEILLGGADPEDDTAALQNKLAAKKAELAKKQTELEKLLDSLDPEGKTQDELDKEAEEAELDKKADELQNKVADLEKEISNLEILLGGADSEDDTAALQNKLATKKAELEKTQKELDAALNELGPDGDEEETPAPAPQPEQPAPAPKPEQPAPAPKPEQPAPAPKPEQPAPAPKPEQPAPAPKPEQPAKPEKPAEEPTQPEKPATPKTGWKQENGMWYFYNTDGSMAIGWLQNNGSWYYLNANGAMATGWVKDGDTWYYLEASGAMKASQWFKVSDKWYYVNSNGAMATGWLQYNGSWYYLNANGDMATGWLQYNGSWYYLNANGDMATGWAKVNGSWYYLNANGAMATGWAKVNGSWYYLNANGSMATGWVKDGDTWYYLEASGAMKASQWFKVSDKWYYVNGLGALAVNTTVDGYKVNANGEWV

SEQ ID NO: 185 - protein, 693 aa, Streptococcus pneumoniae
MFASKSERKVHYSIRKFSVGVASVVVASLVMGSVVHATENEGATQVPTSSNRANESQAEQGEQPKKLDSERDKARKEVEEYVKKIVGESYAKSTKKRHTITVALVNELNNIKNEYLNKIVESTSESQLQILMMESRSKVDEAVSKFEKDSSSSSSSDSSTKPEASDTAKPNKPTEPGEKVAEAKKKVEEAEKKAKDQKEEDRRNYPTITYKTLELEIAESDVEVKKAELELVKVKANEPRDEQKIKQAEAEVESKQAEATRLKKIKTDREEAEEEAKRRADAKEQGKPKGRAKRGVPGELATPDKKENDAKSSDSSVGEETLPSPSLKPEKKVAEAEKKVEEAKKKAEDQKEEDRRNYPTNTYKTLELEIAESDVEVKKAELELVKEEAKEPRNEEKVKQAKAEVESKKAEATRLEKIKTDRKKAEEEAKRKAAEEDKVKEKPAEQPQPAPAPKAEKPAPAPKPENPAEQPKAEKPADQQAEEDYARRSEEEYNRLTQQQPPKTEKPAQPSTPKTGWKQENGMWYFYNTDGSMATGWLQNNGSWYYLNSNGAMATGWLQNNGSWYYLNANGSMATGWLQNNGSWYYLNANGSMATGWLQYNGSWYYLNANGSMATGWLQYNGSWYYLNANGDMATGWVKDGDTWYYLEASGAMKASQWFKVSDKWYYVNGSGALAVNTTVDGYGVNANGEWVN

SEQ ID NO: 186 - protein, 129 aa, Streptococcus pneumoniae
MVKRRIRRGTREPEKVVVPEQSSIPSYPVSVTSNQGTDVAVEPAKAVAPTTDWKQENGMWYFYNTDGSMATGWVQVNSSWYYLNSNGSMKVNQWFQVGGKWYYVNTSGELAVNTSIDGYRVNDNGEWVR

SEQ ID NO: 187 - protein, 230 aa, Streptococcus pneumoniae
LNTSFVHAADGIQYVRDDTRDKEEGIEYDDADNGDIIVKVATKPKVVTKKISSTRIRYEKDETKDRSENPVTIDGEDGYVTTTRTYDVNPETGYVTEQVTVDRKEATDTVIKVPAKSKVEEVLVPFATKYEADNDLSAGQEQEITLGKNGKTVTTITYNVDGKSGQVTESTLSQKKDSQTRVVKKRTKPQVLVQEIPIETEYLDGPTLDKSQEVEEVGEIGKLLLLQSIL

SEQ ID NO: 188 - protein, 340 aa, Streptococcus pneumoniae
MKLLKKMMQIALATFFFGLLATNTVFADDSEGWQFVQENGRTYYKKGDLKETYWRVIDGKYYYFDPLSGEMVVGWQYIPAPHKGVTIGPSPRIEIALRPDWFYFGQDGVLQEFVGKQVLEAKTATNTNKHHGEEYDSQAEKRVYYFEDQRSYHTLKTGWIYEEGHWYYLQKDGGFDSRINRLTVGELARGWVKDYPLTYDEEKLKAAPWYYLNPATGIMQTGWQYLGNRWYYLHSSGAMATGWYKEGSTWYYLDAENGDMRTGWQNLGNKWYYLRSSGAMATGWYQESSTWYYLNASNGDMKTGWFQVNGNWYYAYDSGALAVNTTVGGYYLNYNGEWVK

SEQ ID NO: 189 - protein, 181 aa, Streptococcus pneumoniae
LAGRYGSAVQCTEVTASNLSTVKTKATVVEKPLKDFRASTSDQSGWVESNGKWYFYESGDVKTGWVKTDGKWYYLNDLGVMQTGFVKFSGSWYYLSNSGAMFTGWGTDGSRWFYFDGSGAMKTGWYKENGTWYYLDEAGIMKTGWFKVGPHWYYAYGSGALAVSTTTPDGYRVNGNGEWVN

SEQ ID NO: 190 - protein, 332 aa, Streptococcus pneumoniae
MKILKKTMQVGLTVFFFGLLGTSTVFADDSEGWQFVQENGRTYYKKGDLKETYWRVIDGKYYYFDSLSGEMVVGWQYIPFPSKGSTIGPYPNGIRLEGFPKSEWYYFDKNGVLQEFVGWKTLEIKTKDSVGRKYGEKREDSEDKEEKRYYTNYYFNQNHSLETGWLYDQSNWYYLAKTEINGENYLGGERRAGWINDDSTWYYLDPTTGIMQTGWQYLGNKWYYLRSSGAMATGWYQEGTTWYYLDHPNGDMKTGWQNLGNKWYYLRSSGAMATGWYQDGSTWYYLNAGNGDMKTGWFQVNGNWYYAYSSGALAVNTTVDGYSVNYNGEWVR

SEQ ID NO: 191 - protein, 627 aa, Streptococcus pneumoniae
MKKKLTSLALVGAFLGLSWYGNVQAQESSGNKIHFINVQEGGSDAIILESNGHFAMVDTGEDYDFPDGSDSRYPWREGIETSYKHVLTDRVFRRLKELGVQKLDFILVTHTHSDHIGNVDELLSTYPVDRVYLKKYSDSRITNSERLWDNLYGYDKVLQTAAEKGVSVIQNITQGDAHFQFGDMDIQLYNYENETDSSGELKKIWDDNSNSLISVVKVNGKKIYLGGDLDNVHGAEDKYGPLIGKVDLMKFNHHHDTNKSNTKDFIKNLSPSLIVQTSDSLPWKNGVDSEYVNWLKERGIERINAASKDYDATVFDIRKDGFVNISTSYKPIPSFQAGWHKSAYGNWWYQAPDSTGEYAVGWNEIEGEWYYFNQTGILLQNQWKKWNNHWFYLTDSGASAKNWKKIAGIWYYFNKENQMEIGWIQDKEQWYYLDVDGSMKTGWLQYMGQWYYFAPSGEMKMGWVKDKETWYYMDSTGVMKTGEIEVAGQHYYLEDSGAMKQGWHKKANDWYFYKTDGSRAVGWIKDKDKWYFLKENGQLLVNGKTPEGYTVDSSGAWLVDVSIEKSATIKTTSHSEIKESKEVVKKDLENKETSQHESVTNFSTSQDLTSSTSQSSETSVNKSESEQ

SEQ ID NO: 192 - protein, 318 aa, Streptococcus pneumoniae
MEINVSKLRTDLPQVGVQPYRQVHAHSTGNPHSTVQNEADYHWRKDPELGFFSHIVGNGCIMQVGPVDNGAWDVGGGWNAETYAAVELIESHSTKEEFMTDYRLYIELLRNLADEAGLPKTLDTGSLAGIKTHEYCTNNQPNNHSDHVDPYPYLAKWGISREQFKHDIENGLTIETGWQKNDTGYWYVHSDGSYPKDKFEKINGTWYYFDSSGYMLADRWRKHTDGNWYWFDNSGEMATGWKKIADKWYYFNEEGAMKTGWVKYKDTWYYLDAKEGAMVSNAFIQSADGTGWYYLKPDGTLADKPEFTVEPDGLITVK

SEQ ID NO: 193 - protein, 513 aa, Streptococcus pneumoniae; identical to SEQ ID NO: 37

SEQ ID NO: 194 - protein, 826 aa, Streptococcus pneumoniae
MKINKKYLAGSVAVLALSVCSYELGRHQAGQDKKESNRVAYIDGDQAGQKAENLTPDEVSKREGINAEQIVIKITDQGYVTSHGDHYHYYNGKVPYDAIISEELLMKDPNYQLKDSDIVNEIKGGYVIKVDGKYYVYLKDAAHADNIRTKEEIKRQKQERSHNHGSGANDHAVAAARAQGRYTTDDGYIFNASDIIEDTGDAYIVPHGDHYHYIPKNELSASELAAAEAYWNGKQGSRPSSSSSYNANPAQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSPQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEALDNLLERLKDVPSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEESPEESEEPQVETEKVEEKLREAEDLLGKIQDPIIKSNAKETLTGLKNNLLFGTQDNNTIMAEAEKLLALLKESK

SEQ ID NO: 195 - protein, 295 aa, Streptococcus pneumoniae
MEGLVRVHLLPVFGDYKLSKLTTPILQQQVNKWADKANKGEKGAFANYSLLHNMNKRILKYGVAIQVIQYNPANDVIVPRKQQKEKAAVKYLDNKELKQFLDYLDALDQSNYENLFDVVLYKTLLATGCRISEALALEWSDIDLESGVISINKTLNRYQEINSPKSSAGYRDIPIDKATLLLLKQYKNRQQIQSWKLGRSETVVFSVFTEKYAYACNLRKRLNKHFDAAGVTNVSFHGFRHTHTTMMLYAQVSPKDVQYRLGHSNLMITENTYWHTNQENAKKAVSNYETAINNL

SEQ ID NO: 196 - DNA, 2235 bp, Streptococcus pneumoniae
atgaataagaaaaaaatgattttaacaagtctagccagcgtcgctatcttaggggctggttttgttacgtctcagcctacttttgtaagagcagaagaatctccacaagttgtcgaaaaatcttcattagagaagaaatatgaggaagcaaaagcaaaagctgatactgccaagaaagattacgaaacggctaaaaagaaagcagaagacgctcagaaaaagtatgaagatgatcagaagagaactgaggagaaagctcgaaaagaagcagaagcatctcaaaaattgaatgatgtggcgcttgttgttcaaaatgcatataaagagtaccgagaagttcaaaatcaacgtagtaaatataaatctgacgctgaatatcagaaaaaattaacagaggtcgactctaaaatagagaaggctaggaaagagcaacaggacttgcaaaataaatttaatgaagtaagagcagttgtagttcctgaaccaaatgcgttggctgagactaagaaaaaagcagaagaagctaaagcagaagaaaaagtagctaagagaaaatatgattatgcaactctaaaggtagcactagcgaagaaagaagtagaggctaaggaacttgaaattgaaaaacttcaatatgaaatttctactttggaacaagaagttgctactgctcaacatcaagtagataatttgaaaaaacttcttgctggtgcggatcctgatgatggcacagaagttatagaagctaaattaaaaaaaggagaagctgagctaaacgctaaacaagctgagttagcaaaaaaacaaacagaacttgaaaaacttcttgacagccttgatcctgaaggtaagactcaggatgaattagataaagaagcagaagaagctgagttggataaaaaagctgatgaacttcaaaataaagttgctgatttagaaaaagaaattagtaaccttgaaatattacttggaggggctgatcctgaagatgatactgctgctcttcaaaataaattagctgctaaaaaagctgagttagcaaaaaaacaaacagaacttgaaaaacttcttgacagccttgatcctgaaggtaagactcaggatgaattagataaagaagcagaagaagctgagttggataaaaaagctgatgaacttcaaaataaagttgctgatttagaaaaagaaattagtaaccttgaaatattacttggaggggctgattctgaagatgatactgctgctcttcaaaataaattagctactaaaaaagctgaattggaaaaaactcaaaaagaattagatgcagctcttaatgagttaggccctgatggagatgaagaagaaactccagcgccggctcctcaaccagagcaaccagctcctgcaccaaaaccagagcaaccagctccagctccaaaaccagagcaaccagctcctgcaccaaaaccagagcaaccagctccagctccaaaaccagagcaaccagctccagctccaaaaccagagcaaccagctaagccggagaaaccagctgaagagcctactcaaccagaaaaaccagccactccaaaaacaggctggaaacaagaaaacggtatgtggtatttctacaatactgatggttcaatggcaataggttggctccaaaacaacggttcatggtactacctaaacgctaacggcgctatggcaacaggttgggtgaaagatggagatacctggtactatcttgaagcatcaggtgctatgaaagcaagccaatggttcaaagtatcagataaatggtactatgtcaacagcaatggcgctatggcgacaggctggctccaatacaatggctcatggtactacctcaacgctaatggtgatatggcgacaggatggctccaatacaacggttcatggtattacctcaacgctaatggtgatatggcgacaggatgggctaaagtcaacggttcatggtactacctaaacgctaacggtgctatggctacaggttgggctaaagtcaacggttcatggtactacctaaacgctaacggttcaatggcaacaggttgggtgaaagatggagatacctggtactatcttgaagcatcaggtgctatgaaagcaagccaatggttcaaagtatcagataaatggtactatgtcaatggcttaggtgcccttgcagtcaacacaactgtagatggctataaagtcaatgccaatggtgaatgggtttaa

SEQ ID NO: 197 - DNA, 2082 bp, Streptococcus pneumoniae
atgtttgcatcaaaaagcgaaagaaaagtacattattcaattcgtaaatttagtgttggagtagctagtgtagttgttgccagtcttgttatgggaagtgtggttcatgcgacagagaacgagggagctacccaagtacccacttcttctaatagggcaaatgaaagtcaggcagaacaaggagaacaacctaaaaaactcgattcagaacgagataaggcaaggaaagaggtcgaggaatatgtaaaaaaaatagtgggtgagagctatgcaaaatcaactaaaaagcgacatacaattactgtagctctagttaacgagttgaacaacattaagaacgagtatttgaataaaatagttgaatcaacctcagaaagccaactacagatactgatgatggagagtcgatcaaaagtagatgaagctgtgtctaagtttgaaaaggactcatcttcttcgtcaagttcagactcttccactaaaccggaagcttcagatacagcgaagccaaacaagccgacagaaccaggagaaaaggtagcagaagctaagaagaaggttgaagaagctgagaaaaaagccaaggatcaaaaagaagaagatcgtcgtaactacccaaccattacttacaaaacgcttgaacttgaaattgctgagtccgatgtggaagttaaaaaagcggagcttgaactagtaaaagtgaaagctaacgaacctcgagacgagcaaaaaattaagcaagcagaagcggaagttgagagtaaacaagctgaggctacaaggttaaaaaaaatcaagacagatcgtgaagaagcagaagaagaagctaaacgaagagcagatgctaaagagcaaggtaaaccaaaggggcgggcaaaacgaggagttcctggagagctagcaacacctgataaaaaagaaaatgatgcgaagtcttcagattctagcgtaggtgaagaaactcttccaagcccatccctgaaaccagaaaaaaaggtagcagaagctgagaagaaggttgaagaagctaagaaaaaagccgaggatcaaaaagaagaagatcgccgtaactacccaaccaatacttacaaaacgcttgaacttgaaattgctgagtccgatgtggaagttaaaaaagcggagcttgaactagtaaaagaggaagctaaggaacctcgaaacgaggaaaaagttaagcaagcaaaagcggaagttgagagtaaaaaagctgaggctacaaggttagaaaaaatcaagacagatcgtaaaaaagcagaagaagaagctaaacgaaaagcagcagaagaagataaagttaaagaaaaaccagctgaacaaccacaaccagcgccggctccaaaagcagaaaaaccagctccagctccaaaaccagagaatccagctgaacaaccaaaagcagaaaaaccagctgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcgacaggatggctccaaaacaatggctcatggtactacctcaacagcaatggcgctatggcgacaggatggctccaaaacaatggttcatggtactatctaaacgctaatggttcaatggcaacaggatggctccaaaacaatggttcatggtactacctaaacgctaatggttcaatggcgacaggatggctccaatacaatggctcatggtactacctaaacgctaatggttcaatggcgacaggatggctccaatacaatggctcatggtactacctaaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaactaa

SEQ ID NO: 198 - DNA, 390 bp, Streptococcus pneumoniae
atggtaaaaagacgtataaggagagggacgagagaacctgaaaaagttgttgttcctgagcaatcatctattccttcgtatcctgtatctgttacatctaaccaaggaacagatgtagcagtagaaccagctaaagcagttgctccaacaacagactggaaacaagaaaatggtatgtggtatttttataatactgatggttccatggcaacaggttgggtacaagttaatagttcatggtactacctcaacagcaacggttctatgaaagtcaatcaatggttccaagttggtggtaaatggtattatgtaaatacatcgggtgagttagcggtcaatacaagtatagatggctatagagtcaatgataatggtgaatgggtgcgttaa

SEQ ID NO: 199 - DNA, 693 bp, Streptococcus pneumoniae
ctgaatacaagttttgttcatgctgctgatgggattcaatatgtcagagatgatactagagataaagaagagggaatagagtatgatgacgctgacaatggggatattattgtaaaagtagcgactaaacctaaggtagtaaccaagaaaatttcaagtacgcgaattcgttatgaaaaagatgaaacaaaagaccgtagtgaaaatcctgttacaattgatggagaggatggctatgtaactacgacaaggacctacgatgttaatccagagactggttatgttaccgaacaggttactgttgatagaaaagaagccacggatacagttatcaaagttccagctaaaagcaaggttgaagaagttcttgttccatttgctactaaatatgaagcagacaatgacctttctgcaggacaggagcaagagattactctaggaaagaatgggaaaacagttacaacgataacttataatgtagatggaaagagtggacaagtaactgagagtactttaagtcaaaaaaaagactctcaaacaagagttgttaaaaaaagaaccaagccccaagttcttgtccaagaaattccaatcgaaacagaatatctcgatggcccaactcttgataaaagtcaagaagtagaagaagtaggagaaattggtaaattactcttactacaatctatactgtag

SEQ ID NO: 200 - DNA, 1023 bp, Streptococcus pneumoniae
atgaagcttttgaaaaaaatgatgcaaatcgcactagccacatttttcttcggtttgttagcgacaaatacagtatttgcagatgattctgaaggatggcagtttgtccaagaaaatggtagaacctactacaaaaagggggatctaaaagaaacctactggagagtgatagatgggaagtactattattttgatcctttatccggagagatggttgtcggctggcaatatatacctgctccacacaagggggttacgattggtccttctccaagaatagagattgctcttagaccagattggttttattttggtcaagatggtgtattacaagaatttgttggcaagcaagttttagaagcaaaaactgctacgaataccaacaaacatcatggggaagaatatgatagccaagcagagaaacgagtctattattttgaagatcagcgtagttatcatactttaaaaactggttggatttatgaagagggtcattggtattatttacagaaggatggtggctttgattcgcgcatcaacagattgacggttggagagctagcacgtggttgggttaaggattaccctcttacgtatgatgaagagaagctaaaagcagctccatggtactatctaaatccagcaactggcattatgcaaacaggttggcaatatctaggtaatagatggtactacctccattcgtcaggagctatggcaactggctggtataaggaaggctcaacttggtactatctagatgctgaaaatggtgatatgagaactggctggcaaaaccttgggaacaaatggtactatctccgttcatcaggagctatggcaactggttggtatcaggaaagttcgacttggtactatctaaatgcaagtaatggagatatgaaaacaggctggttccaagtcaatggtaactggtactatgcctatgattcaggtgctttagctgttaataccacagtaggtggttactacttaaactataatggtgaatgggttaagtaa

SEQ ID NO: 201 - DNA, 546 bp, Streptococcus pneumoniae
ttggctggtagatatggttctgctgttcagtgtacagaagtgactgcctcaaacctttcaacagttaaaactaaagctacggttgtagaaaaaccactgaaagattttagagcgtctacgtctgatcagtctggttgggtggaatctaatggtaaatggtatttctatgagtctggtgatgtgaagacaggttgggtgaaaacagatggtaaatggtactatttgaatgacttaggtgtcatgcagactggatttgtaaaattttctggtagctggtattacttgagcaattcaggtgctatgtttacaggctggggaacagatggtagcagatggttctactttgacggctcaggagctatgaagacaggctggtacaaggaaaatggcacttggtattaccttgacgaagcaggtatcatgaagacaggttggtttaaagtcggaccacactggtactatgcctacggttcaggagctttggctgtgagcacaacaacaccagatggttaccgtgtaaatggtaatggtgaatgggtaaactag

SEQ ID NO: 202 - DNA, 999 bp, Streptococcus pneumoniae
atgaaaattttgaaaaaaactatgcaagttggactgacagtatttttctttggtttgctagggaccagtacagtatttgcagatgattctgaaggatggcagtttgtccaagaaaacggaagaacctactacaaaaagggggacctcaaagaaacctactggcgagtgattgatggtaagtactattattttgattctctatctggagagatggttgtcggctggcaatatatcccgtttccatctaaaggtagtacaattggtccttacccaaatggtatcagattagaaggttttccaaagtcagagtggtactacttcgataaaaatggagtgctacaagagtttgttggttggaaaacattagagattaaaactaaagacagtgttggaagaaagtacggggaaaaacgtgaagattcagaagataaagaagagaagcgttattatacgaactattactttaatcaaaatcattctttagagacaggttggctttatgatcagtctaactggtattatctagctaagacggaaattaatggagaaaactaccttggtggtgaaagacgtgcggggtggataaacgatgattcgacttggtactacctagatccaacaactggtattatgcaaacaggttggcaatatctaggtaataagtggtactacctccgttcctcaggagcaatggccactggctggtatcaggaaggtaccacttggtattatttagaccacccaaatggcgatatgaaaacaggttggcaaaaccttgggaacaaatggtactatctccgttcatcaggagctatggcaactggttggtatcaagatggttcaacttggtactacctaaatgcaggtaatggagacatgaagacaggttggttccaggtcaatggcaactggtactatgcttatagctcaggtgctttggcagtgaatacgaccgtagatggctattctgtcaactataatggcgaatgggttcggtaa

SEQ ID NO: 203 - DNA, 1884 bp, Streptococcus pneumoniae
atgaaaaagaaattaactagtttagcacttgtaggcgcttttttaggtttgtcatggtatgggaatgttcaggctcaagaaagttcaggaaataaaatccactttatcaatgttcaagaaggtggcagtgatgcgattattcttgaaagcaatggacattttgccatggtggatacaggagaagattatgatttcccagatggaagtgattctcgctatccatggagagaaggaattgaaacgtcttataagcatgttctaacagaccgtgtctttcgtcgtttgaaggaattgggtgtccaaaaacttgattttattttggtgacccatacccacagtgatcatattggaaatgttgatgaattactgtctacctatccagttgaccgagtctatcttaagaaatatagtgatagtcgtattactaattctgaacgtctatgggataatctgtatggctatgataaggttttacagactgctgcagaaaaaggtgtttcagttattcaaaatatcacacaaggggatgctcattttcagtttggggacatggatattcagctctataattatgaaaatgaaactgattcatcgggtgaattaaagaaaatttgggatgacaattccaattccttgattagcgtggtgaaagtcaatggcaagaaaatttaccttgggggcgatttagataatgttcatggagcagaagacaagtatggtcctctcattggaaaagttgatttgatgaagtttaatcatcaccatgataccaacaaatcaaataccaaggatttcattaaaaatttgagtccgagtttgattgttcaaacttcggatagtctaccttggaaaaatggtgttgatagtgagtatgttaattggctcaaagaacgaggaattgagagaatcaacgcagccagcaaagactatgatgcaacagtttttgatattcgaaaagacggttttgtcaatatttcaacatcctacaagccgattccaagttttcaagctggttggcataagagtgcatatgggaactggtggtatcaagcgcctgattctacaggagagtatgctgtcggttggaatgaaatcgaaggtgaatggtattactttaaccaaacgggtatcttgttacagaatcaatggaaaaaatggaacaatcattggttctatttgacagactctggtgcttctgctaaaaattggaagaaaatcgctggaatctggtattattttaacaaagaaaaccagatggaaattggttggattcaagataaagagcagtggtattatttggatgttgatggttctatgaagacaggatggcttcaatatatggggcaatggtattactttgctccatcaggggaaatgaaaatgggctgggtaaaagataaagaaacctggtactatatggattctactggtgtcatgaagacaggtgagatagaagttgctggtcaacattattatctggaagattcaggagctatgaagcaaggctggcataaaaaggcaaatgattggtatttctacaagacagacggttcacgagctgtgggttggatcaaggacaaggataaatggtacttcttgaaagaaaatggtcaattacttgtgaacggtaagacaccagaaggttatactgtggattcaagtggtgcctggttagtggatgtttcgatcgagaaatctgctacaattaaaactacaagtcattcagaaataaaagaatccaaagaagtagtgaaaaaggatcttgaaaataaagaaacgagtcaacatgaaagtgttacaaatttttcaactagtcaagatttgacatcctcaacttcacaaagctctgaaacgagtgtaaacaaatcggaatcagaacagtag

SEQ ID NO: 204 - DNA, 957 bp, Streptococcus pneumoniae
atggaaattaatgtgagtaaattaagaacagatttgcctcaagtcggcgtgcaaccatataggcaagtacacgcacactcaactgggaatccgcattcaaccgtacagaatgaagcggattatcactggcggaaagacccagaattaggttttttctcgcacattgttgggaacggttgcatcatgcaggtaggacctgttgataatggtgcctgggacgttgggggcggttggaatgctgagacctatgcagcggttgaactgattgaaagccattcaaccaaagaagagttcatgacggactaccgcctttatatcgaactcttacgcaatctagcagatgaagcaggtttgccgaaaacgcttgatacagggagtttagctggaattaaaacgcacgagtattgcacgaataaccaaccaaacaaccactcagaccacgttgacccttatccatatcttgctaaatggggcattagccgtgagcagtttaagcatgatattgagaacggcttgacgattgaaacaggctggcagaagaatgacactggctactggtacgtacattcagacggctcttatccaaaagacaagtttgagaaaatcaatggcacttggtactactttgacagttcaggctatatgcttgcagaccgctggaggaagcacacagacggcaactggtactggttcgacaactcaggcgaaatggctacaggctggaagaaaatcgctgataagtggtactatttcaacgaagaaggtgccatgaagacaggctgggtcaagtacaaggacacttggtactacttagacgctaaagaaggcgccatggtatcaaatgcctttatccagtcagcggacggaacaggctggtactacctcaaaccagacggaacactggcagacaagccagaattcacagtagagccagatggcttgattacagtaaaataa

SEQ ID NO: 205 - DNA, 1542 bp, Streptococcus pneumoniae
atgggcacaacaggatttacaataattgacttaattatcttgattgtttatttacttgcggtgttggttgcaggtatctatttctctaaaaaagagatgaaaggaaaagagttctttaaaggagatggttcggttccttggtatgttacttcggtatccatttttgccacaatgctcagtccgatttccttcttgggactcgctggtagctcttatgcaggtagctggattttatggtttgctcaattagggatggtagtagctattccactgacaattcgttttatcttacctatctttgcacggatagacatcgatacggcatatgattacttggataaacgttttaattctaaagcacttcgtattatttcagcactcttgtttattatttatcaattgggacgtatgtctatcattatgtacctcccatcagctggtttatcagtattgacaggaattgacatcaatattttgattattttgatgggtgtagttgcaattgtttattcttatactggtggtctaaaatccgtattatggacagactttattcaaggtgtgattctgattagtggtgtcgttttagctttatttgtactgattgctaatattaaaggtggctttggtgcagtagcagaaacattagcaaacgggaaattccttgctgcaaatgaaaaacttttcgatcctaacttgctttcaaactccatctttttaattgtgatgggttcaggctttacaatcttgtcttcctatgcttcatctcaagatttggttcaacgttttactacaacacaaaatattaagaaacttaataagatgttgttcacaaacggtgttttgtcacttgcaactgcaacagtcttttacttgattggtacaggcttgtacgtattctatcaagtacaaaatgcagatagtgcagctagcaatatccctcaagaccaaatctttatgtactttattgcataccagttaccagtaggtatcacaggtttgatcttggcagcgatttatgcagcatctcaatcaactatttcaacaggtttgaactctgttgcaacttcatggacattggatattcaagatgtcatttctaaaaatatgtcagacaatcgtcgtacgaaaattgcacaattcgtatctctagcagtaggtttattctcaattggtgtttccattgtcatggctcactcagatattaaatctgcatacgaatggttcaatagtttcatgggacttgtacttggtctacttggtggtgtatttattcttggatttgtttctaaaaaagcaaataaacaaggtgcttatgcagcgctgattgtatcaaccatcgtcatggtatttattaaatacttccttcctccaacagctgttagctactgggcatattcattgatttcaatctctgtatcagtagtttcaggttatattgtatctgttcttactggaaataaagtatctgcacctaaatatacaacgattcatgatattacagaaattaaagcggattcaagttgggaagttcgtcactaa

SEQ ID NO: 206 - DNA, 2481 bp, Streptococcus pneumoniae
atgaaaattaataaaaaatatctagcaggttcagtggcagtccttgccctaagtgtttgttcctatgagcttggtcgtcaccaagctggtcaggataagaaagagtctaatcgagttgcttatatagatggtgatcaggctggtcaaaaggcagaaaacttgacaccagatgaagtcagtaagagggaggggatcaacgccgaacaaatcgtcatcaagattacggatcaaggttatgtgacctctcatggagaccattatcattactataatggcaaggtcccttatgatgccatcatcagtgaagagctcctcatgaaagatccgaattatcagttgaaggattcagacattgtcaatgaaatcaagggtggttatgtcatcaaggtagacggaaaatactatgtttaccttaaggatgcagctcatgcggataatattcggacaaaagaagagattaaacgtcagaagcaggaacgcagtcataatcacgggtcaggagctaacgatcatgcagtagctgcagccagagcccaaggacgctatacaacggatgatgggtatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagctcaaccaagattgtcagagaaccacaatctgactgtcactccaacttatcatcaaaatcaaggggaaaacatttcaagccttttacgtgaattgtatgctaaacccttatcagaacgccatgtggaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaacaaccaagtccacaatcgactccggaacctagtccaagtccgcaacctgcaccaaatcctcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggctttggataacctgttggaacgactcaaggatgtcccaagtgataaagtcaagttagtggatgatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcaaagaaacaaaaatggtcaagctgataccaatcaaacggaaaaaccaagcgaggagaaacctcagacagaaaaacctgaggaagaaacccctcgagaagagaaaccgcaaagcgagaaaccagagtctccaaaaccaacagaggaaccagaagaatcaccagaggaatcagaagaacctcaggtcgagactgaaaaggttgaagaaaaactgagagaggctgaagatttacttggaaaaatccaggatccaattatcaagtccaatgccaaagagactctcacaggattaaaaaataatttactatttggcacccaggacaacaatactattatggcagaagctgaaaaactattggctttattaaaggagagtaagtaa

SEQ ID NO: 207 - DNA, 888 bp, Streptococcus pneumoniae
atggagggattggttagagtgcatttattgcctgtatttggcgattacaagctatctaaacttactacgcctattcttcaacagcaagtaaacaaatgggctgacaaggcaaataaaggcgaaaaaggggcatttgctaactactctttgctccataacatgaataagcgtattttgaaatatggcgtagctatccaggtaatacaatacaacccagctaatgatgtcatcgttccacgcaaacagcaaaaagaaaaggctgctgtcaaatacttagacaacaaagaattaaaacagtttcttgattatttagatgctctggatcaatcaaattatgagaacttatttgatgttgttctgtataagactttattggccactggttgccgtattagtgaggctctggctcttgaatggtctgatattgacctagaaagcggtgttatcagcatcaataagacactaaaccgctatcaggaaataaactcacctaaatcaagcgctggttatcgtgatataccaatagacaaagccacattacttttactgaaacaatacaaaaaccgtcaacaaattcagtcttggaaattaggccgatctgaaacagttgtattctctgtatttacggagaaatatgcttatgcttgtaacttacgcaaacgcctaaataagcattttgatgctgctggagtaactaacgtatcatttcatggtttccgccatacacatactactatgatgctctatgctcaggttagcccgaaagatgttcagtatagattaggccactctaatttaatgatcactgaaaatacttactggcatactaaccaagagaatgcaaaaaaagccgtctcaaattatgaaacagctatcaacaatttataa

SEQ ID NO: 208 - DNA, 624 bp, Streptococcus pneumoniae
atggaagagttagtgaccttagattgtttgtttattgacagaactaagattgaagccaatgccaacaagtatagttttgtgtggaagaaaacgacagagaaattctccgccaaacttcaagaacagatacaggtctattttcaagaagaaatcactccccttctgattaaatatgccatgtttgataagaaacaaaagagagggtataaagagtcagctaaaaacttagcgaattggcactataatgacaaggaggatagctacacacatcctgatggctggtattatcgttttcaccataccaaatatcagaaaacacagacagactttcaacaagaaatcaaggtttactacgccgacgaacctgaatcagcccctcaaaagggactgtatatgaacgaacgctatcaaaacttgaaagctaaagaatgtcaggcgcttttatctccccaaggtagacagattttcgctcaacgcaagattgatgtggaacctgtctttgggcagataaaggcttctttgggttacaagagatgtaatctgagagggaagcgtcaagtgagaattgacatgggattggtacttatggccaataacctcctaaaatatagtaaaatgaaataa

SEQ ID NO: 209 - DNA, 6702 bp, Streptococcus pneumoniae
atggggaaaggccattggaatcggaaaagagtttatagcattcgtaagtttgctgtgggagcttgctcagtaatgattgggacttgtgcagttttattaggaggaaatatagctggagaatctgtagtttatgcggatgaaacacttattactcatactgctgagaaacctaaagaggaaaaaatgatagtagaagaaaaggctgataaagctttggaaactaaaaatatagttgaaaggacagaacaaagtgaacctagttcaactgaggctattgcatctgagaagaaagaagatgaagccgtaactccaaaagaggaaaaagtgtctgctaaaccggaagaaaaagctccaaggatagaatcacaagcttcaaatcaagaaaaaccgctcaaggaagatgctaaagctgtaacaaatgaagaagtgaatcaaatgattgaagacaggaaagtggattttaatcaaaattggtactttaaactcaatgcaaattctaaggaagccattaaacctgatgcagacgtatctacgtggaaaaaattagatttaccgtatgactggagtatctttaacgatttcgatcatgaatctcctgcacaaaatgaaggtggacagctcaacggtggggaagcttggtatcgcaagactttcaaactagatgaaaaagacctcaagaaaaatgttcgccttacttttgatggcgtctacatggattctcaagtttatgtcaatggtcagttagtggggcattatccaaatggttataaccagttctcatatgatatcaccaaataccttcaaaaagatggtcgtgagaatgtgattgctgtccatgcagtcaacaaacagccaagtagccgttggtattcaggaagtggtatctatcgtgatgtgactttacaagtgacagataaggtgcatgttgagaaaaatgggacaactattttaacaccaaaacttgaagaacaacaacatggcaaggttgaaactcatgtgaccagcaaaatcgtcaatacggacgacaaagaccatgaacttgtagccgaatatcaaatcgttgaacgaggtggtcatgctgtaacaggcttagttcgtacagcgagtcgtaccttaaaagcacatgaatcaacaagcctagatgcgattttagaagttgaaagaccaaaactctggactgttttaaatgacaaacctgccttgtacgaattgattacgcgtgtttaccgtgacggtcaattggttgatgctaagaaggatttgtttggttaccgttactatcactggactccaaatgaaggtttctctttgaatggtgaacgtattaaattccatggagtatccttgcaccacgaccatggggcgcttggagcagaagaaaactataaagcagaatatcgccgtctcaaacaaatgaaggagatgggagttaactccatccgtacaacccacaaccctgctagtgagcaaaccttgcaaatcgcagcagaactaggtttactcgttcaggaagaggcctttgatacgtggtatggtggcaagaaaccttatgactatggacgtttctttgaaaaagatgccactcacccagaagctcgaaaaggtgaaaaatggtctgattttgacctacgtaccatggtcgaaagaggcaaaaacaaccctgctatcttcatgtggtcaattggtaatgaaataggtgaagctaatggtgatgcccactctttagcaactgttaaacgtttggttaaggttatcaaggatgttgataagactcgctatgttaccatgggagcagataaattccgtttcggtaatggtagcggagggcatgagaaaattgctgatgaactcgatgctgttggatttaactattctgaagataattacaaagcccttagagctaagcatccaaaatggttgatttatggatcagaaacatcttcagctacccgtacacgtggaagttactatcgccctgaacgtgaattgaaacatagcaatggacctgagcgtaattatgaacagtcagattatggaaatgatcgtgtgggttgggggaaaacagcaaccgcttcatggacttttgaccgtgacaacgctggctatgctggacagtttatctggacaggtacggactatattggtgaacctacaccatggcacaaccaaaatcaaactcctgttaagagctcttactttggtatcgtagatacagccggcattccaaaacatgacttctatctctaccaaagccaatgggtttctgttaagaagaaaccgatggtacaccttcttcctcactggaactgggaaaacaaagaattagcatccaaagtagctgactcagaaggtaagattccagttcgtgcttattcgaatgcttctagtgtagaattgttcttgaatggaaaatctcttggtcttaagactttcaataaaaaacaaaccagcgatgggcggacttaccaagaaggtgcaaatgctaatgaactttatcttgaatggaaagttgcctatcaaccaggtaccttggaagcaattgctcgtgatgaatctggcaaggaaattgctcgagataagattacgactgctggtaagccagcggcagttcgtcttattaaggaagaccatgcgattgcagcagatggaaaagacttgacttacatctactatgaaattgttgacagccaggggaatgtggttccaactgctaataatctggttcgcttccaattgcatggccaaggtcaactggtcggtgtagataacggagaacaagccagccgtgaacgctataaggcgcaagcagatggttcttggattcgtaaagcatttaatggtaaaggtgttgccattgtcaaatcaactgaacaagcagggaaattcaccctgactgcccactctgatctcttgaaatcgaaccaagtcactgtctttactggtaagaaagaaggacaagagaagactgttttggggacagaagtgccaaaagtacagaccattattggagaggcacctgaaatgcctaccactgttccgtttgtatacagtgatggtagccgtgcagaacgtcctgtaacctggtcttcagtagatgtgagcaagcctggtattgtaacggtgaaaggtatggctgacggacgagaagtagaagctcgtgtagaagtgattgctcttaaatcagagctaccagttgtgaaacgtattgctccaaatactgacttgaattctgtagacaaatctgtttcctatgttttgattgatggaagtgttgaagagtatgaagtggacaagtgggagattgccgaagaagataaagctaagttagcaattccaggttctcgtattcaagcgaccggttatttagaaggtcaaccaattcatgcaacccttgtggtagaagaaggcaatcctgcggcacctgcagtaccaactgtaacggttggtggtgaggcagtaacaggtcttactagtcaaaaaccaatgcaataccgcactcttgcttatggagctaagttgccagaagtcacagcaagtgctaaaaatgcagctgttacagttcttcaagcaagcgcagcaaacggcatgcgtgcgagcatctttattcagcctaaagatggtggccctcttcaaacctatgcaattcaattccttgaagaagcgccaaaaattgctcacttgagcttgcaagtggaaaaagctgacagtctcaaagaagaccaaactgtcaaattgtcggttcgagctcactatcaagatggaacgcaagctgtattaccagctgataaagtaaccttctctacaagtggtgaaggggaagtcgcaattcgtaaaggaatgcttgagttgcataagccaggagcagtcactctgaacgctgaatatgagggagctaaagaccaagttgaactcactatccaagccaatactgagaagaagattgcgcaatccatccgtcctgtaaatgtagtgacagatttgcatcaggaaccaagtcttccagcaacagtaacagttgagtatgacaaaggtttccctaaaactcataaagtcacttggcaagctattccgaaagaaaaactagactcctatcaaacatttgaagtactaggtaaagttgaaggaattgaccttgaagcgcgtgcaaaagtctctgtagaaggtatcgtttcagttgaagaagtcagtgtgacaactccaatcgcagaagcaccacaattaccagaaagtgttcggacatatgattcaaatggtcacgtttcatcagctaaggttgcatgggatgcgattcgtccagagcaatacgctaaggaaggtgtctttacagttaatggtcgcttagaaggtacgcaattaacaactaaacttcatgttcgcgtatctgctcaaactgagcaaggtgcaaacatttctgaccaatggaccggttcagaattgccacttgcctttgcttcagactcaaatccaagcgacccagtttcaaatgttaatgacaagctcatttcctacaataaccaaccagccaatcgttggacaaactggaatcgtactaatccagaagcttcagtcggtgttctgtttggagattcaggtatcttgagcaaacgctccgttgataatctaagtgtcggattccatgaagaccatggagttggtgtaccgaagtcttatgtgattgagtattatgttggtaagactgtcccaacagctcctaaaaaccctagttttgttggtaatgaggaccatgtctttaatgattctgccaactggaaaccagttactaatctaaaagcccctgctcaactcaaggctggagaaatgaaccactttagctttgataaagttgaaacctatgctgttcgtattcgcatggttaaagcagataacaagcgtggaacgtctatcacagaggtacaaatctttgcgaaacaagttgcggcagccaagcaaggacaaacaagaatccaagttgacggcaaagacttagcaaacttcaaccctgatttgacagactactaccttgagtctgtagatggaaaagttccggcagtcacagcaagtgttagcaacaatggtctcgctaccgtcgttccaagcgttcgtgaaggtgagccagttcgtgtcatcgcgaaagctgaaaatggcgacatcttaggagaataccgtctgcacttcactaaggataagagcttactttctcataaaccagttgctgcggttaaacaagctcgcttgctacaagtaggtcaagcacttgaattgccgactaaggttccagtttacttcacaggtaaagacggctacgaaacaaaagacctgacagttgaatgggaagaagttccagcggaaaatctgacaaaagcaggtcaatttactgttcgaggccgtgtccttggtagtaaccttgttgctgagatcactgtacgagtgacagacaaacttggtgagactctttcagataaccctaactatgatgaaaacagtaaccaggcctttgcttcagcaaccaatgatattgacaaaaactctcatgaccgcgttgactatctcaatgacggagatcattcagaaaatcgtcgttggacaaactggtcaccaacaccatcttctaatccagaagtatcagcgggtgtgattttccgtgaaaatggtaagattgtagaacggactgttacacaaggaaaagttcagttctttgcagatagtggtacggatgcaccatctaaactcgttttagaacgctatgtcggtccagagtttgaagtgccaacctactattcaaactaccaagcctacgacgcagaccatccattcaacaatccagaaaattgggaagctgttccttatcgtgcggataaagacattgcagctggtgatgaaatcaacgtaacatttaaagctatcaaagccaaagctatgagatggcgtatggagcgtaaagcagataagagcggtgttgcgatgattgagatgaccttccttgcaccaagtgaattgcctcaagaaagcactcaatcaaagattcttgtagatggaaaagaacttgctgatttcgctgaaaatcgtcaagactatcaaattacctataaaggtcaacggccaaaagtctcagttgaagaaaacaatcaagtagcttcaactgtggtagatagtggagaagatagctttccagtacttgttcgcctcgtttcagaaagtggaaaacaagtcaaggaataccgtatccacttgactaaggaaaaaccagtttctgagaagacagttgctgctgtacaagaagatcttccaaaaatcgaatttgttgaaaaagatttggcatacaagacagttgagaaaaaagattcaacactgtatctaggtgaaactcgtgtagaacaagaaggaaaagttggaaaagaacgtatctttacagcgattaatcctgatggaagtaaggaagaaaaactccgtgaagtggtagaagttccgacagaccgcatcgtcttggttggaaccaaaccagtagctcaagaagctaaaaaaccacaagtgtcagaaaaagcagatacaaaaccaattgattcaagtgaagctagtcaaactaataaagcccagttaccaagtacaggtagtgcggcaagccaagcagcagtagcagcaggtttaactcttctaggtttgagtgcaggattagtagttactaaaggtaaaaaagaagactag

SEQ ID NO: 210 - DNA, 1476 bp, Streptococcus pneumoniae
atggatgcaatctttgacctaatcggaaaggttttcaatcccatcttagaaatgggtggacctgtcatcatgttaatcattttgacagtattggctttactttttggagtgaaattctccaaagcgcttgaaggtggtatcaaacttgccatcgctcttacaggtatcggtgctatcatcggtatgctaaacactgctttctcagcatcactagcaaaattcgttgaaaacactggtatccaattgagtattaccgacgttggttgggcaccacttgctacaatcacttggggttctgcttggacactatacttcttgctcatcatgttgattgtcaacatagtgatgctagctatgaagaaaacagatacacttgatgtcgatatctttgatatctggcacttgtctatcacaggtctcttgattaaatggtatgctgataacaatggtgtgagtcaaggggtttcactctttattgctacagcagctatcgtccttgtcggtgtgttgaaaattatcaactctgacttgatgaaacctacatttgatgaccttcttaacgccccaagttcatcaccaatgacatcaactcacatgaactacatgatgaacccagttatcatggttttggataagatttttgaaaaattcttcccaggccttgataaatatgactttgatgctgctaaattgaacaagaaaatcggtttctggggatctaaattcttcatcggtttcatccttggtatcgttatcggtattatgggaactccacatccaattgcaggtgttgcagatgcagataaatggcgtcttgttatcaaaggatggttgtctcttggtttgactgccggtgtatctttggaactcttctcacttatcggttcatggttcatcgcagccgtagaaccactatcacaaggtattacaaacgttgctactaaacgtcttcaaggacgtaaattcaatatcggtcttgactggccattcatcgctggtcgtgctgaaatctgggcttgtgccaacgtacttgcaccaatcatgttgattgaagcagtgcttctttcaaaagttggaaatggtatcttgccacttgcaggtatcatcgctatgggtgttactccagctctcttggttgtaactcgtggtaaattgctccgtatgattatcttcggaacactcttgttgccactcttccttctttcaggtacacttattgcaccatttgcaacagaacttgctaaaggtgtaggtgccttcccagaaggtgtgagccaaactcaattgattactcactctactcttgaaggaccaatcgaaaaacttcttggttggacaattggtaacactacaactggtgatatcaaagcaatccttggtgcagtagtcttccttgtattctatatcggtatctttgcttggtacagaaaacaaatgatcaaacgtaacgaagagtacgcagcaaaagcaaaataa

SEQ ID NO: 211 - DNA, 1413 bp, Streptococcus pneumoniae
atgaagattatgaaaaaaaaatattggactttagcgatattattcttttgtttgttcaataattctgttactgctcaagaaatacctaaaaatcttgatggcaatataactcacactcagactagcgaaagtttttctgaatctgatgaaaaacaggttgactattctaataaaaatcaagaagaagtagaccaaaataaatttcgtattcaaatcgataagacagaattatttgtaacaacagataaacatttagaaaaaaactgttgtaaattggaacttgaaccacaaataaataacgatattgttaactctgaaagtaataatttactaggcgaagataatttagataataaaattaaggaaaatgtttctcatctagataatagaggaggaaatatagagcatgacaaagataacttagaatcgtcgattgtaagaaaatatgaatgggatatagataaagttactggtggaggcgaaagttataaattatattctaaaagtaattctaaagtttcaattgctattttagattcaggagtcgatttacaaaatactggattactgaaaaatctttcaaatcactcaaaaaactatgtccccaataaaggatatttaggaaaagaggagggagaggaaggaataatatcagatattcaagatagattaggtcatggtacggctgttgtagctcaaattgtaggggatgacaatattaatggagtaaatcctcacgttaatattaacgtctatagaatatttggtaagtcgtcagctagtccagattggattgtaaaagcaatttttgatgctgtagatgatggcaatgatattatcaatcttagtactggacaatatttaatgattgatggagaatatgaggacggaacaaatgattttgaaacatttttgaagtataaaaaggctattgattacgcgaatcaaaaaggagtaattatagtagctgcattagggaatgactccctaaatgtatcaaatcagtcagatttattgaaacttattagttcacgcaaaaaagtaagaaaaccaggattagtagttgatgttccaagttatttctcatctacaatttcggtcggaggcatagatcgcttaggtaatttatcagattttagcaataaaggggattctgatgcaatatatgcgcctgcaggctcaacattatctctttcagaattaggacttaataactttattaatgcagaaaaatataaagaagattggattttttcggcaacactaggaggatatacgtatctttatggaaactcatttgctgctcctaaagtttctggtgcgattgcaatgattattgataaatacaaattaaaagatcagccctataattatatgtttgtaaaaaaattctggaagaaacattaccagtaa

SEQ ID NO: 212 - DNA, 1008 bp, Streptococcus pneumoniae
atgaagaaaacatggaaagtgtttttaacgcttgtaacagctcttgtagctgttgtgcttgtggcctgtggtcaaggaactgcttctaaagacaacaaagaggcagaacttaagaaggttgactttatcctagactggacaccaaataccaaccacacagggctttatgttgccaaggaaaaaggttatttcaaagaagctggagtggatgttgatttgaaattgccaccagaagaaagttcttctgacttggttatcaacggaaaggcaccatttgcagtgtatttccaagactacatggctaagaaattggaaaaaggagcaggaatcactgccgttgcagctattgttgaacacaatacatcaggaatcatctctcgtaaatctgataatgtaagcagtccaaaagacttggttggtaagaaatatgggacatggaatgacccaactgaacttgctatgttgaaaaccttggtagaatctcaaggtggagactttgagaaggttgaaaaagtaccaaataacgactcaaactcaatcacaccgattgccaatggcgtctttgatactgcttggatttactacggttgggatggtatccttgctaaatctcaaggtgtagatgctaacttcatgtacttgaaagactatgtcaaggagtttgactactattcaccagttatcatcgcaaacaacgactatctgaaagataacaaagaagaagctcgcaaagtcatccaagccatcaaaaaaggctaccaatatgccatggaacatccagaagaagctgcagatattctcatcaagaatgcacctgaactcaaggaaaaacgtgactttgtcatcgaatctcaaaaatacttgtcaaaagaatacgcaagcgacaaggaaaaatggggtcaatttgacgcagctcgctggaatgctttctacaaatgggataaagaaaatggtatccttaaagaagacttgacagacaaaggcttcaccaacgaatttgtgaaataa

SEQ ID NO: 213 - DNA, 1332 bp, Streptococcus pneumoniae; identical to SEQ ID NO: 168

SEQ ID NO: 214 - DNA, 1428 bp, Streptococcus pneumoniae
atgtatttaggagatttgatggagaaagccgagtgtggtcaattttcaatactttcctttctattacaagagtctcagacgaccgtcaaggctgtaatggaagaaacaggattttcaaaagcaaccctaaccaaatatgtcaccctgctcaatgacaaggctttggatagtggcttagagctggctattcactcagaagatgaaaatctgcgtctgtctatcggtgcagctaccaaggggagagatattcggagcttgtttttggagagtgctgttaaataccagattttggtttatcttctctaccaccaacagtttttagcccatcagctggctcaagaattggtgattagcgaggctacgcttggtcgtcacttggctggtttaaatcagattttgtcagaatttgatttatccatccaaaatggccgttggcgaggtccagagcatcagattcactatttctatttctgtcttttccgaaaggtctggtcgagtcaggaatgggaaggtcacatgcagaaaccagagagaaaacaggagattgccaatttagaggaaatctgcggtgcaagtttgtctgcggggcagaaattggacttggttctctgggctcacatcagtcaacaacgtcttcgggtcaatgcttgtcagtttcaagtcatagaagagaaaatgcgagggtattttgacaatatcttttatcttcgtttgctgagaaaggttccgtccttttttgctgggcaacatattccactaggagttgaggatggtgagatgatgatattcttctcttttctcctatctcatcgcattcttcctcttcatactatggagtatattcttggttttggagggcagttggcagatttactgacgcaattgattcaagaaatgaagaaggaggaactattgggggattatacagaggaccatgtcacctatgaactcagtcagctttgtgctcaagtctatctctataagggctatattttacaggatcgctacaagtaccagttagagaatcgtcatccatatttactgatggaacatgattttaaagagacagcagaggagatttttcatgctctacctgcttttcaacaggggacagatttagataagaagattctctgggaatggctccagttaatcgaatatatggctgaaaacggtggccagcatatgcggattggtctggatttgacatctggttttcttgtcttttcaaggatggcagccattttgaaacggtatttggaatacaatcgttttattaccattgaagcttatgaccctagtcggcattatgatttgctggttaccaataacccgattcataagaaggaacagacaccagtctattatttaaaaaatgacttggatatggaggatttggtagcgattcgccagttattattcacttaa

SEQ ID NO: 215 - DNA, 1827 bp, Streptococcus pneumoniae
atggaattttcaaagaaaacacgtgaattgtcaattaaaaaaatgcaggaacgtaccctggacctcttgattatcggtggaggaatcacaggagctggtgtagccttgcaggcggcagctagcggtcttgagactggtttgattgaaatgcaagactttgcagaaggaacatctagtcgttcaacaaaattggttcacggaggacttcgttacctcaaacaatttgacgtagaagtggtctcagatacggtttctgaacgtgcagtggttcaacaaatcgctccacacattccaaaatcagatccaatgctcttaccagtttacgatgaagatggagcaacctttagcctcttccgtcttaaagtagccatggacttgtacgacctcttggcaggtgttagcaacacaccagctgcgaacaaggttttgagcaaggatcaagtcttggaacgccagccaaacttgaagaaggaaggcttggtaggaggtggagtgtatcttgacttccgtaacaacgatgcgcgtctcgtgattgaaaacatcaaacgtgccaaccaagacggtgccctcattgccaaccacgtgaaggcagaaggcttcctctttgacgaaagtggcaagattacaggtgttgtagctcgtgatctcttgacagaccaagtgtttgaaatcaaggcccgtctggttattaatacaacaggtccttggagtgataaagtacgtaatttgtctaataagggaacgcaattctcacaaatgcgcccaactaagggagttcacttggtagtagattcaagcaaaatcaaggtttcacagccagtttacttcgacacaggtttgggtgacggtcgtatggtctttgttctcccacgtgaaaacaagacttactttggtacaactgatacagactacacaggtgatttggagcatccaaaagtaactcaagaagatgtagattatctacttggcattgtcaacaaccgcttcccagaatccaacatcaccattgatgatatcgaaagcagctgggcaggtcttcgtccattgattgcagggaacagtgcctctgactataatggtggaaataacggtaccatcagtgatgaaagctttgacaacttgattgcgactgttgaatcttatctctccaaagaaaaaacacgtgaagatgttgagtctgctgtcagcaagcttgaaagtagcacatctgagaaacatttggatccatctgcagtttctcgtgggtctagcttggaccgtgatgacaatggtctcttgactcttgctggtggtaaaatcacagactaccgtaagatggctgaaggagctatggagcgcgtggttgacatcctcaaagcagaatttgaccgtagctttaaattgatcaattctaaaacttaccctgtttcaggtggagaattgaacccagcaaatgtggattcagaaatcgaagcctttgcgcaacttggagtatcacgtggtttggatagcaaggaagctcactatctggcaaatctttacggttcaaatgcaccgaaagtctttgcacttgctcacagcttggaacaagcgccaggactcagcttggcagatactttgtcccttcactatgcaatgcgcaatgagttgactcttagcccagttgacttccttcttcgtcgtaccaatcacatgctctttatgcgtgatagcttggatagtatcgttgagccaattttggatgaaatgggacgattctatgactggacagaagaagaaaaagcaacttaccgtgctgatgtcgaagcagctctcgctaacaacgatttagcagaattaaaaaattaa

SEQ ID NO: 216 - DNA, 705 bp, Streptococcus pneumoniae
atgatgaatgaattatttggagaatttctagggactttaatcctgattcttctaggaaatggtgttgttgcaggtgtggttcttcctaaaaccaagagcaatagctcaggttggattgtgattactatgggttgggggattgcagttgcggttgcagtctttgtatctggcaagctcagtccagcttatttaaacccagctgtgaccatcggtgtggccttaaaaggtggtttgccttgggcttccgttttgccttatatcttagcccagttcgcaggggccatgctgggtcagattttggtttggttgcaattcaaacctcactatgaggcagaagaaaatgcaggcaatatcctggcaaccttcagtactggaccagccatcaaggatactgtatcaaacttgattagcgaaatccttggaacttttgttttggtgttgacaatctttgctttgggtctttacgactttcaggcaggtatcggaacctttgcagtgggaactttgattgtcggtatcggtctatcactaggtgggacaacaggttatgccttgaacccagctcgtgaccttggacctcgtatcatgcacagcatcttgccaattccaaacaagggagacggagactggtcttacgcttggattcctgttgtaggccctgttatcggagcagccttggcagtgcttgtattctcacttttctag

SEQ ID NO: 217 - DNA, 1008 bp, Streptococcus pneumoniae
atgaaaaggacctggaggaactcattcgtgacaaatcttaatacaccttttatgattggcaatattgagattcccaatcgtaccgttttagcgcctatggctggcgtgaccaactcagcctttcgtactatcgcaaaggagctcggagctggactcgttgtaatggaaatggtctctgacaagggaatccaatacaacaacgaaaaaaccctgcacatgcttcatatcgatgagggcgaaaaccctgtctctatccaactttttggtagcgatgaagacagcctagcacgcgcagcagaattcatccaagaaaacaccaagaccgatatcgtcgatatcaacatgggctgccctgtcaacaaaatcgtgaagaacgaagctggtgctatgtggctcaaggatccagacaagatttactccatcatcaacaaggtccagtctgtccttgatatcccacttactgtcaaaatgcgtaccggctgggcggacccatctcttgcagtagaaaatgctctcgctgctgaagctgcaggtgtttctgccctcgccatgcatggccgtacccgtgaacaaatgtatactggccacgcagaccttgagaccctttacaaggttgcccaagctctaaccaagattccattcatcgccaacggtgatatccgtactgtccaagaagccaagcaacgcatcgaagaagttggtgctgacgcagtcatgattggccgagctgccatgggaaatccttacctcttcaaccaaatcaaccattactttgaaacaggagaaatcctacctgatttgacctttgaagacaagatgaagatcgcctacgaacacttgaaacgattgattaacctcaaaggagaaaacgtcgcagttcgtgaattccgcggtctcgctcctcactatctccgtggaacatctggcgctgccaaactccgtggagccatttcgcaagccagcaccctggcagagattgaaaccctcttgcaattggagaaggcttaa

SEQ ID NO: 218 - DNA, 411 bp, Streptococcus pneumoniae
atgacaaagaagaaaattgagcgtatttctgtaatacaccgagaaaagattttatggctcaagtggtatttcatgcgagataaagaacaacctaagtatagtgtccttgagcgtaaaatgtttgatgctgctaaaaatcaagatatgctagcttatcaaaaatacgcaactatcaagcagataacagatattagggtacaaacaagtgaggctgacattttagaggctgtaaaagaggtttatgtgtacaatcacatgaatgttatcggagcttgtcagcggatattatttatcagtcaatcaccagcttatgataagttaaataagtggtttaatatctattctgatttgtattttagcgttgtacccttgcccaaaatgggggtatatcatgagatggtaggtatctag

SEQ ID NO: 219 - DNA, 3300 bp, Streptococcus pneumoniae
atgaaaaattccaacgaggctgagatgaaattactttatactgatattcggacttctttgacagaaattctaacaagagaggcagaagagctagttgcagctggcaagcgggtcttctacattgcccccaactctctttcttttgaaaaggaacgcgccgtgctggaatacttgtcccagcaggcttctttttcgattaccgtcacgcgctttgctcaaatggctcgctatctggtcttgaatgatttaccagctaaaactactcttgatgatatcggtcttgggttggccttttacaaatgccttgccgaactcgatcccaaggacttgcgtgtttatggcgctattaagcaggatcctcaattgatccagcagttaattgagctttaccatgagatgaccaaatctcagatgagttttttggacttggagaatttaacagatgaggataagagggcggatttactcttgatttttgagaaagtaacagcctatcttaatcaaggtcagttagcccaggaaagtcagttgtcccatttgattgaggctattgagaatgacaaggtaagtagtgattttaatcaaatcgccttggtcattgacggctttactcgtttttctgctgaggaagagcgggttgtggacttacttcacggcaaaggtgttgagattgttatcggggcttatgctagtaagaaagcctataccagtccttttagcgagggcaatctctaccaagccagcgtaaaatttctccatcatctggcttctaaataccaaacgcctgctcaggactgttctcaaactcatgagaagatggatagttttgacaaggcctctcgtttgttggagtcttcttatgacttttcagaactcgctttggatgtcgatgagaaagaccgtgaaaatttacaaatctggtcttgtttgacgcaaaaggaggagttggagctagtagcccgtagtattcgtcagaaattacatgagaactcagacctgagctacaagcattttcgtattctcttgggggatgtagcttcttaccagttatctctcaaaaccatttttgaccagtatcagattcctttttatcttggtagaagcgaagccatggctcatcatcccttgactcagtttgtcgagtctattttagctttaaaacgttaccgttttcgtcaggaggatttgattaatcttcttagaactgatttgtatactgacctcagtcagtctgatattgatgcttttgagcaatatatccgctatcttggtatcaatggcttgccagcctttcagcaaaccttcaccaaatcccaccatggaaaatttaatcttgagcgtttgaatgtcctccgcctgagaattttagcacctcttgaaaccctctttgccagccgaaaacaaaaggctgaaaaactcctacaaaaatggagtgtctttctaaaagaaggagctgtgaccaagcagttacaagatttgacaaccactttggaagctgtagaacaggaaagacaagccgaagtttggaaggctttctgccatgttttagaacaatttgcgactgtttttgctggttcacaggttagtctggaagacttcctagccttgctccattctggaatgagtttgtcccaataccgtaccattccagcaacagtggacactgttctggtgcagagttacgatttgattgcaccattgactgctgactttgtctatgctattggactaactcaggacaatttaccaaaaatttctcaaaacaccagtcttctgacagatgaagaaaggcaaaacctaaaccaagcgaccgaagaaggcgttcaattactgattgccagcagtgaaaatctcaagaaaaatcgctacactatgctttccttggtcaattctgctcgtaagcagttgttcttgtcggctccaagcctttttaacgaaagtgaaagtaaggaatctgcctatcttcaagagttgatccattttggatttaggcggagagagaagaggatgaatcacaaaggactgtctaaggaggatatggggtcctatcacagtcttttgtctagtctggttgcctatcaccagcagggtgagatgagcgatactgagcaagatttgacttttgtcaaggttctgtcgcgtgtcataggtaaaaaactagatcagcaaggtctggaaaatccagctatcccaaccagtccaagcagcaagaccttagccaaggacaccttgcaagctctctatcctgccaaacaggagttttacctgtctacgtcgggtttgacagagttttatcgcaatgaatacagttatttcctacgctacgttttaggcttgcaggaggaattacgtttgcatcctgatgcccgtagtcacgggaatttcttgcatcgtatctttgaacgcgccttacagttgcctaatgaagattcctttgaccaacgtctagaacaagctattcaagaaaccagtcaagaacgcgaatttgaagctatttatcaagaaagtttggaagcccagtttaccaaggaagttttgcttgatgttgcacggacaactggacatattctccgacacaatccagccatcgaaaccatcaaagaagaagcaaattttggtggaaaagaccaagcctttattcaattagacaatggacgcagtgtctttgtacgaggcaaggtggaccggattgaccgtttgaaagctaatggagcgataggagtagtagactacaaatccagtctgactcagttccagtttcctcatttctttaatgggctcaattctcagttaccaacctatcttgctgccctaaaaagagaaggggagcagaactttttcggcgccatgtacttggaaatggctgaacctgtccaatctctgatggcggtaaaaagtctggcaggagcagtggtagaagccagcaaatctatgaaataccaagggctcttcttggaaaaagaaagcagttatttaggcgaattttataacaaaaacaaggctaatcaactgacagatgaggaatttcagctcctactggactacaatgcctatctttacaagaaagctgctgagaagattttagcaggccggttcgccatcaatccttatactgaaaatggcagaagcattgccccatacgtccagcaacatcaggctattacaggctttgaagccaattaccatctgggccaagcccgtttcctagaaaagttggacctagctgatggcaagcgtctggtcggagaaaaactcaagcaagcttggcttgaaaaaataagagaggagttgaatcgatga

SEQ ID NO: 220 - DNA, 3651 bp, Streptococcus pneumoniae
atgaagcttattccctttttaagtgaggaggagattcaaaaactgcaagaagcagaagcaaattcgagcaaggaacagaagaaaactgccgagcaaatcgaagctatctacacttctgcccagaatatcctggtctcagcatcggctggttctggaaagacctttgtcatggcagagcgcattctggaccaattggcgcgtggtgtcgaaatttctcaactctttatctcaacctttaccgtcaaggctgcaactgaacttaaagaacgtttagagaaaaaaatcagcaagaaaatccaagaaacagatgatgtcgacctcaaacaacacttgggtcgccagttggcagacctacccaacgctgccattggaaccatggattctttcacacaaaaattccttggcaaacatggttatctgcttgatattgcacctaatttccgtattttacaaaaccaaagcgagcaacttattctcgaaaacgaagtctttcatgaggtctttgaagcgcattaccaaggtaaacagaaagagacctttagtcatttgctgaaaaactttgctgggcgtggcaaggacgaacggggtctgcgccagcaggtctataaaatctatgacttcctccaatccaccagtaatcctcaaaagtggctgagtgaatctttcctcaaaggatttgagaaagctgattttaccagtgaaaaagaaaaactgaccgagcaaatcaaacaagccctttgggatttggaaagctttttccgttaccatctggataacgatgccaaggagtttgcaaaggctgcctatttagaaaatgttcagttaattctggatgaaattggctccctaaatcaggagtccgatagtcaggcttatcaggcagtgcttgcgcgtgttgtcgccatctctaaggagaaaaacggtcgagctctgactaatgccagccgtaaggctgatttgaagcccctggctgatgcctacaacgaagagagaaagacccagtttgctaaactaggacaattatcagaccagatagcgattctcgactatcaagaacgttatcatggagacacttggaaactagctaaaaccttccaatctttcatgagcgattttgtagaggcttatcgtcagagaaaacgacaggaaaatgccttcgaattcgctgatatcagccattacaccattgagattttagagaatttcccacaagttcgtgagtcttatcaggagcgcttccatgaagtcatggtcgatgagtatcaggataccaaccatattcaagaacggatgctggaattgttgtctaatggccacaatcgctttatggtgggagatatcaagcaatccatctatcgtttccgtcaggcagacccgcagattttcaatgagaaattccaacgctatgcgcaaaatccccaagaaggcaggctcattatcctcaaggaaaatttccgtagtagttcagaagtgctgtcagcaaccaatgatgtctttgaacgtctcatggaccaagaggtcggcgaaatcaactatgataacaagcaccagcttgtttttgccaataccaaactgactcccaatccagacaacaaggcagcatttctcctctacgacaaggacgatacaggtgaggaagaagagagtcaaacagaaacgaaactaacaggcgaaatgcgcttagttatcaaggagattctgaaacttcatcaagaaaaaggtgttgcctttaaggaaattgcccttctgacctccagccgcagtcgtaatgaccagattctcctcgccctgtctgagtacggaattcctgtcaaaactgacggagagcaaaacaattatctccaatccctagaagtgcaagtcatgctagacactcttcgtgtcattcacaatcccctgcaagactacgccttggttgcccttatgaagtctccaatgtttggttttgatgaggatgagctagcacgtttgtcccttcagaaagcagaggataaagtccacgaaaatctctatgagaaactggtcaatgcacaaaaaatggcaagtagtcaaaaaggcttgattcacacagctctagctgaaaaactaaagcaattcatggatatcctagcttcttggcgcttgtatgccaaaacccactctctctatgacttgatttggaagatttacaacgaccgtttttattatgactatgttggggctttgccgaatggtcctgctaggcaggccaatctctatgccctagcactgcgtgctgatcaatttgaaaagagcaatttcaaaggtttgtcgcgttttattcgtatgattgaccaagtcttagaagcccagcacgatttggcaagcgtggccgtcgcaccgccaaaagatgcagtagagctcatgaccatccacaagagtaaagggctggagtttccttacgtctttatcctcaatatggatcaagatttcaacaagcaagactctatgtcagaagtcattctcagtcgtcagaatggtcttggtgtcaaatatattgccaagatggagacaggggcagtagaagaccactatcctaaaaccatcaaactctccattcctagtctgacctataggcagaacgaagaggaattacagctagcaagctattctgagcagatgcgtttgctgtatgttgctatgacgcgggctgagaaaaagctctatcttgtcggcaagggttctcgtgaaaagctggaatccaaggaatacccagcagccaaaaatgggaaactaaatagcaatactagactgcaagcacggaatttccaagattggctttgggctatcagtaaagtgtttactaaggacaagctcaactttagttatcgttttattggcgaagatcagttgaccagagaagctatcggagagttggaaaccaagagtcctctccaagatagctcccaagcagacaatcgtcagtcagataccatcaaagaagctctggaaatgctgaaggaggtggaagtttataatactcttcaccgcgcagctattgaacttcctagtgttcaaaccccaagtcaaatcaagaaattctacgaaccagttatggatatggaaggtgtcgagattgctggtcaaggtcagtcagtaggcaagaaaatcagcttcgatttgccagatttttcaaccaaagaaaaggtaactggagctgagattggtagtgctactcacgaactcatgcagagaattgacctcagccagcaactaacccttgctagcctaacagaaacactcaaacaagttcaaactagccaagctgtcagagacaagatcaatcttgataaaattcttgctttctttgacacagtactcggtcaggaaattcttgctaataccgaccatctttatcgcgagcaacctttctccatgctcaaacgagaccaaaagagtcaggaagactttgttgtccgtggtatccttgatggctatctgctttacgaaaacaaaattgttctgttcgactacaagacagaccgctatgatgaaccaagtcaactcgtagaccgctatcgtggtcagttagctctatacgaagaggctttatcacgagcctattcgattgaaaatattgaaaaatacttgattttactcggtaaagacgaggttcaagttgtaaaagtataa

SEQ ID NO: 221 - DNA, 648 bp, Streptococcus pneumoniae
atggaacttgctcgccatgctgaaagcttgggagtagatgctattgcaacgattccaccaatttatttccgcttgccagaatactcagttgccaaatactggaacgatatcagttctgcagctccaaacacagactacgtgatttacaacattcctcaattggcaggggttgctttgactccaagcctttacacagaaatgttgaaaaatcctcgtgttatcggtgtgaagaactcttctatgccagttcaagatatccaaacctttgtcagccttggtggagaagaccatatcgtctttaatggtcctgatgagcagttcctaggaggacgcctcatgggggctagggctggtatcggtggtacttatggtgctatgccagaactcttcttgaaactcaatcagttgattgcggataaggacctagaaacagcgcgtgaattgcagtatgctatcaacgcaatcattggtaaactcacttctgctcatggaaatatgtacggtgtcatcaaagaagtcttgaaaatcaatgaaggcttgaatattggatctgttcgttcaccattgacaccagtgactgaagaagatcgtccagttgtagaagcggctgctgccttgattcgtgaaaccaaggagcgcttcctctaa

SEQ ID NO: 222 - DNA, 1224 bp, Streptococcus pneumoniae
atgtataagacaaagtgtttacgagagaagttagtattatttttaaaaattttcttcccaatcctgatctaccaatttgccaattattctgcctcttttgttgatactgcaatgacaggtcaatacaacactatggacttggctggtgtatctatggcaaccagtatctggaatcctttctttacatttctaacagggattgtgtcagccttggtgcctatcattggtcaccatcttggtcgaggcaaaaaggaagaagttgcgtctgatttttaccaatttatttatttggccttgggcctatctgtggtcttgctggggatggtacttttcttggcaccaataatcttgaatcatattgggttagaagcagcagtagcggcagtagcggttcgctatctttggtttttatctatcgggattatccccttgttgctctttagcgtcattcgttccttgctggattcgctgggcttgaccaaactgtccatgtacctcatgcttttgttactccctctcaatagcggatttaactatctcttgatttacggtgcctttggtgttccagaactgggaggggctggtgctggtttaggaacatccttggcctactgggtcttgcttgggatttctgttctggttttatttaaacaggagaagctcaaagccttacaccttgagaaacgaattccacttaatatggataaaattaaggaaggagttcgtttaggtctgcctattgggggaactgtcttcgcggaagtggctatcttttcagtggttggcttgattatggctaagttttcgcccttgattatagctagtcaccagtcagctatgaacttttcaagtcttatgtacgcctttcctatgagtatctcatcggctatggctattgtcgtttcctatgaagtgggagccaagcgatttgatgatgcgaaaacctatattggtctaggaagatggactgccctcatttttgcggccttcaccttaaccttcctttacatttttaggggaaatgtggccagtctttatggtaacgacccaaaatttatcgatttgacagtgcgttttttaacttatagtcttttcttccagttagcagatacctttgcggcgccgcttcagggaattttgcgggggtataaggatacagttattcctttttaccttggtttgcttggttattggggcgtagcaatccctgtgtacgctatttga

SEQ ID NO: 223 - DNA, 570 bp, Streptococcus pneumoniae
atgagtactttagcaaaaatagaagcgctcttgtttgtagcgggtgaagatgggattcgggtccgccagttagctgaactcctctctctgccaccgacaggcatccagcaaagtttaggaaaattagcccagaagtatgaaaaggacccagattccagtttggctttgattgagacaagtggtgcttatagattggtgaccaagcctcaatttgcagagattttgaaggaatactctaaggcgcctatcaaccagagcttgtctcgggctgcccttgagaccttgtccattattgcctacaaacagccgattacgcggatagaaattgatgccatccgtggagttaactcgagtggagccttggcaaagttgcaggcttttgacctgataaaggaagacgggaaaaaggaagtattggggcgccccaacctctatgtgactacggattatttcctagattacatggggataaaccatttagaagaattaccagtgattgatgagcttgagattcaagcccaagaaagccaattatttggtgaaaggatagaagaagatgagaatcaataa

SEQ ID NO: 224 - DNA, 936 bp, Streptococcus pneumoniae
atggatacgatgattagtagattttttcgccatttatttgaagccttaaaaagtttgaaacgaaatggttggatgacagtagctgctgtcagttcagtcatgattactttgaccttggtggcaatatttgcatctgttattttcaatacagcgaaactagctacagatattgaaaataatgtccgtgtagtagtttatatccgaaaggatgtggaagataatagtcagacaattgaaaaagaaggtcaaactgttacaaataatgactaccacaaggtatatgattctttgaagaacatgtctacggttaaaagtgttaccttttcaagtaaagaagaacaatatgaaaaattaaccgagataatgggagataactggaaaatctttgaaggagatgccaatcctctctatgatgcctatattgtagaggcaaacactccaaatgatgtaaaaactatagccgaagatgctaaaaaaattgaaggtgtctctgaggttcaagatggcggtgccaatacagaaagactcttcaagttagcttcatttatccgtgtttggggactagggattgctgctttgttaatttttatcgcagttttcttgatttcaaataccattcgtattaccattatttcccgcagtcgcgaaattcaaatcatgcgcttggtcggagctaaaaacagttatatccgtggaccgttcttgttagaaggagcctttatcggtttattgggagctatcgcaccatctgttttggtctttattgtttatcaaattgtttaccaatctgtcaacaaatcgttggtagggcaaaatctatccatgattagtccagatttatttagtccgttgatgattgccctactatttgtgattggggttttcattggttcattgggatcaggaatatccatgcgccgattcttgaagatttag

SEQ ID NO: 225 - DNA, 1977 bp, Streptococcus pneumoniae
atgaagaaagtaagatttatttttttagctctgctatttttcttagctagtccagagggtgcaatggctagtgatggtacttggcaaggaaaacagtatctgaaagaagatggcagtcaagcagcaaatgagtgggtttttgatactcattatcaatcttggttctatataaaagcagatgctaactatgctgaaaatgaatggctaaagcaaggtgacgactatttttacctcaaatctggtggctatatggccaaatcagaatgggtagaagacaagggagccttttattatcttgaccaagatggaaagatgaaaagaaatgcttgggtaggaacttcctatgttggtgcaacaggtgccaaagtaatagaagactgggtctatgattctcaatacgatgcttggttttatatcaaagcagatggacagcacgcagagaaagaatggctccaaattaaagggaaggactattatttcaaatccggtggttatctactgacaagtcagtggattaatcaagcttatgtgaatgctagtggtgccaaagtacagcaaggttggctttttgacaaacaataccaatcttggttttacatcaaagaaaatggaaactatgctgataaagaatggattttcgagaatggtcactattattatctaaaatccggtggctacatggcagccaatgaatggatttgggataaggaatcttggttttatctcaaatttgatgggaaaatggctgaaaaagaatgggtctacgattctcatagtcaagcttggtactacttcaaatccggtggttacatgacagccaatgaatggatttgggataaggaatcttggttttatctcaaatctgatgggaaaatagctgaaaaagaatgggtctacgattctcatagtcaagcttggtactacttcaaatccggtggttacatgacagccaatgaatggatttgggataaggaatcttggttttacctcaaatctgatgggaaaatagctgaaaaagaatgggtctacgattctcatagtcaagcttggtactacttcaaatctggtggctacatggcgaaaaatgagacagtagatggttatcagcttggaagcgatggtaaatggcttggaggaaaaactacaaatgaaaatgctgcttactatcaagtagtgcctgttacagccaatgtttatgattcagatggtgaaaagctttcctatatatcgcaaggtagtgtcgtatggctagataaggatagaaaaagtgatgacaagcgcttggctattactatttctggtttgtcaggctatatgaaaacagaagatttacaagcgctagatgctagtaaggactttatcccttattatgagagtgatggccaccgtttttatcactatgtggctcagaatgctagtatcccagtagcttctcatctttctgatatggaagtaggcaagaaatattattcggcagatggcctgcattttgatggttttaagcttgagaatcccttccttttcaaagatttaacagaggctacaaactacagtgctgaagaattggataaggtatttagtttgctaaacattaacaatagccttttggagaacaagggcgctacttttaaggaagccgaagaacattaccatatcaatgctctttatctccttgcccatagtgccctagaaagtaactggggaagaagtaaaattgccaaagataagaataatttctttggcattacagcctatgatacgaccccttacctttctgctaagacatttgatgatgtggataagggaattttaggtgcaaccaagtggattaaggaaaattatatcgataggggaagaactttccttggaaacaaggcttctggtatgaatgtggaatatgcttcagacccttattggggcgaaaaaattgctagtgtgatgatgaaaatcaatgagaagctaggtggcaaagattag

SEQ ID NO: 226 - DNA, 867 bp, Streptococcus pneumoniae
atgaaaaaagtattacaaaaatattgggcatgggcttttgtggtcatccccctcttgttacaagcaattttcttctatgtgccgatgtttcaaggagccttttacagttttaccaactggacaggattgacttataactacaaatttgttggcttaaacaactttaagctcctcttcatggatccaaaattcatgaatgcgattggctttaccgcaatcattgcgattgccatggtggttggtgagattgcactcgggatcttcattgcgcgtgtcttgaattctaaaatcaaaggccaaaccttcttccgtgcttggttcttcttcccagctgttttatctggtttgacagtggctttgatcttcaagcaagtcttcaactacggtcttccagcgattggaaatgcccttcatattgaatttttccaaaccagtcttttagggactaagtggggagcaatctttgcggctgtctttgtccttctttggcaaggggtggctatgcccatcatcatcttcctagctggtttgcaatctattccaactgagattacagaggcagcaaggattgatggtgcgactagcaagcaagttttctggaacattgaattgccttacttgctaccaagtgtctctatggtctttatcctagccctaaaaggtgggctgactgcctttgaccaagtctttgccatgaccggtggtggtccaaacaatgccacaacctcacttgggctcttggtttataactatgcctttaaaaacaaccaattcggttatgccaatgccattgccgtaatcttgttcttcttaattgtagtgatttcgatcatccaattgagagtatctaagaaatttgaaatttaa

SEQ ID NO: 227 - DNA, 837 bp, Streptococcus pneumoniae
atgatgaaacaagatgaaagaaaagccctgattggcaaatacattctattgattctaggatcggttctgattttagtgccgctccttgctaccctctttagttccttcaaacccactaaggatattgtagataatttctttggctttccaaccaacttcacatgggacaactttagccgtctcttagctgatgggattggaggctattattggaactctgtcgtcatcactgtcttgtctttacttgcagtaatgatctttatccctatggcagcctactccatcgctcgcaatatgagtaaaagaaaagcctttaccatcatgtataccctcttaatcctcggaatcttcgtacctttccaagtcatcatgattccgattacggttatgatgagtaaactcggtttggctaatacctttggtttgatcttgctctacttgacctatgcgattccacagaccctctttctctatgttggctatatcaaaatctcgattccagaaagtctggatgaagcagcagagatcgatggggctaatcaatttacaacctatttccgcatcatcttcccaatgatgaaaccgatgcatgcgacaaccatgatcatcaatgccctttggttctggaatgacttcatgttgccactccttgtcttgaaccgggattccaaaatgtggactctgcctttgttccaatacaactacgcaggccaatatttcaacgactacggaccaagctttgcctcttacgtggtcggcattatcagtatcaccattgtctatctcttcttccaacgccatatcatttcaggaatgagcaacggggcagtgaagtaa

SEQ ID NO: 228 - DNA, 1044 bp, Streptococcus pneumoniae
atgaaaagtattcttcagaaaatgggggagcatccgatgctgcttctttttcttagctatagtactgttatatccattcttgcacaaaattggatgggtcttgtggcttcagtaggaatgtttctatttactattttctttttgcactatcagtcgattttatcccataaattctttcgattgattttgcagtttgtcttgtttggtagtgtcttgtcagctgcttttgccagtttagaacatttccaaattgtgaagaaatttaactatgcttttctttcacccaatatgcaggtgtggcatcagaaccgggcagaagtgaccttctttaatcctaattattatggaattatttgttgtttctgtattatgattgctttctatctgtttacaacgaccaagttgaattggttgaaagtattctgtgtgattgcaggctttgttaatctctttggtttgaactttactcaaaatcgaactgcctttcctgctattatcgctggagcaattatctatctctttacgactattaaaaactggaaggccttttggcttagtattggggtcttcgcgattggtttgagtttcctcttttctagtgatttgggagttcgaatgggtactttagactcttctatggaagaacgcatttctatctgggatgctgggatggccttgtttaagcaaaatcctttttggggtgaagggccattgacctatatgaactcttatcctcggatacatgctccttatcatgaacatgcccacagtctttatattgatacgattctgagttacggaattgtggggactattttattagttttgtcttctgttgctcctgttcgcttgatgatggatatgagtcaggagtcggggaaacgtccgattatcggcctttatctatctttccttacagtggttgctgtgcacggaatttttgacttggctctcttctggattcagtcaggctttattttcttgctagttatgtgcagtattccattggagcatcgaatgttggtatcggacatgacggattaa

SEQ ID NO: 229 - DNA, 1299 bp, Streptococcus pneumoniae
atgtcaaagatggatgttcagaaaatcattgcaccgatgatgaagtttgtgaatatgcgtggcattatagctctaaaagatgggatgttagcaattttgccattgacagtagttggtagtttgttcttgattatgggacaattgccgttcgaaggattaaataagagcattgctagtgtttttggagctaattggacagagccgtttatgcaagtatattcaggaacttttgctattatgggtctaatttcttgtttttcaattgcctattcttatgctaagaatagcggagtagaggctttaccagctggagttctatctgtatctgcattctttattttgctaagatcatcttatatccctaaacaaggtgaggcgattggggacgctattagtaaagtttggtttggaggccaaggaattatcggtgctatcattataggtttggtagtaggaagtatttataccttctttataaagagaaaaattgttattaagatgccagaacaagttccacaagctattgccaaacagtttgaagcaatgattccagcatttgtaattttcttatcttctatgattgtatatattttagcgaagtcattgactaatggcggaacattcatagaaatgatttattctgctattcaagttccgttgcaaggtttaactggatctttgtatggtgctattggaattgcattctttatatcatttttgtggtggtttggtgttcatgggcaatcggtagtaaatggagtagtgacagctctgcttttatctaatcttgatgctaataaagctatgttagcctctgctaatctatcattagaaaatggtgcacatattgttactcaacaatttttagattcatttttaattctatcaggttcagggattacgtttggtcttgtagttgccatgctttttgcagcaaaatcaaaacaataccaagccttaggaaaagttgcagcttttccagcaatatttaacgtaaatgagccagttgtatttggatttccgattgtcatgaatccagttatgtttgtacctttcattcttgttcctgtacttgcagctgtgatagtatatggagctattgcaacaggtttcatgcagccattctcaggggtaacattgccttggagtacaccagctattttatcaggatttttggtgggtggatggcaaggagttattactcagctggtgatattagcgatgtctacattggtttattttccattctttaaagtacaggatcgtttagcttaccaaaatgaaatcaaacaatcttag

SEQ ID NO: 230 - DNA, 303 bp, Streptococcus pneumoniae
atgaagaaaaaggacttagtagaccaactagtctcagagatcgagacggggaaagtcaggacactgggaatatacggtcatggagcttcaggtaaatcaacctttgcacaggaattgtaccaagctttagattctactacagtaaatttgctagagacagatccttatatcacctcaggacgccatctggtagtacccaaggacgcgccgaatcaaaaggtgacagccagtctgccagtggcgcatgaactggagagtttgcagagagatatccttgcttgcaggcgggtatggatgtcttga

SEQ ID NO: 231 - DNA, 717 bp, Streptococcus pneumoniae
atgaagaaaagatacctagtcttgacagctttgctagccttgagtctagcagcttgttcacaagaaaaaacaaaaaatgaagatggagaaactaagacagaacagacagccaaagctgatggaacagtcggtagtaagtctcaaggagctgcccagaagaaagcagaagtggtcaataaaggtgattactacagcattcaagggaaatacgatgaaatcatcgtagccaacaaacactatccattgtctaaagactataatccaggggaaaatccaacagccaaggcagagttggtcaaactcatcaaagcgatgcaagaggcaggtttccctattagtgatcattacagtggttttagaagttatgaaactcagaccaagctctatcaagattatgtcaaccaagatggaaaggcagcagctgaccgttactctgcccgtcctggctatagcgaacaccagacaggcttggcctttgatgtgattgggactgatggtgatttggtgacagaagaaaaagcagcccaatggctcttggatcatgcagctgattatggctttgttgtccgttatctcaaaggcaaggaaaaggaaacaggctatatggctgaagaatggcacctgcgttatgtaggaaaagaagctaaagaaattgctgcaagtggtctcagtttggaagaatactatggctttgaaggcggagactacgtcgattaa

SEQ ID NO: 232 - DNA, 1269 bp, Streptococcus pneumoniae
atgcgtaaattcttaattattttgttgctaccaagttttttgaccatttcaaaagtcgttagcacagaaaaagaagtcgtctatacttcgaaagaaatttattacctttcacaatctgactttggtatttattttagagaaaaattaagttctcccatggtttatggagaggttcctgtttatgcgaatgaagatttagtagtggaatctgggaaattgactcccaaaacaagttttcaaataaccgagtggcgcttaaataaacaaggaattccagtatttaagctatcaaatcatcaatttatagctgcggacaaacgatttttatatgatcaatcagaggtaactccaacaataaaaaaagtatggttagaatctgactttaaactgtacaatagtccttatgatttaaaagaagtgaaatcatccttatcagcttattcgcaagtatcaatcgacaagaccatgtttgtagaaggaagagaatttctacatattgatcaggctggatgggtagctaaagaatcaacttctgaagaagataatcggatgagtaaagttcaagaaatgttatctgaaaaatatcagaaagattctttctctatttatgttaagcaactgactactggaaaagaagctggtatcaatcaagatgaaaagatgtatgcagccagcgttttgaaactctcttatctctattatacgcaagaaaaaataaatgagggtctttatcagttagatacgactgtaaaatacgtatctgcagtcaatgattttccaggttcttataaaccagagggaagtggtagtcttcctaaaaaagaagataataaagaatattctttaaaggatttaattacgaaagtatcaaaagaatctgataatgtagctcataatctattgggatattacatttcaaaccaatctgatgccacattcaaatccaagatgtctgccattatgggagatgattgggatccaaaagaaaaattgatttcttctaagatggccgggaagtttatggaagctatttataatcaaaatggatttgtgctagagtctttgactaaaacagattttgatagtcagcgaattgccaaaggtgtttctgttaaagtagctcataaaattggagatgcggatgaatttaagcatgatacgggtgttgtctatgcagattctccatttattctttctattttcactaagaattctgattatgatacgatttctaagatagccaaggatgtttatgaggttctaaaatga

SEQ ID NO: 233 - DNA, 1959 bp, Streptococcus pneumoniae
atgaaaaaacaaaataatggtttaattaaaaatccttttctatggttattatttatctttttccttgtgacaggattccagtatttctattctgggaataactcaggaggaagtcagcaaatcaactatactgagttggtacaagaaattaccgatggtaatgtaaaagaattaacttaccaaccaaatggtagtgttatcgaagtttctggtgtctataaaaatcctaaaacaagtaaagaagaaacaggtattcagtttttcacgccatctgttactaaggtagagaaatttaccagcactattcttcctgcagatactaccgtatcagaattgcaaaaacttgctactgaccataaagcagaagtaactgttaagcatgaaagttcaagtggtatatggattaatctactcgtatccattgtgccatttggaattctattcttcttcctattctctatgatgggaaatatgggaggaggcaatggccgtaatccaatgagttttggacgtagtaaggctaaagcagcaaataaagaagatattaaagtaagattttcagatgttgctggagctgaggaagaaaaacaagaactagttgaagttgttgagttcttaaaagatccaaaacgattcacaaaacttggagcccgtattccagcaggtgttcttttggagggacctccggggacaggtaaaactttgcttgctaaggcagtcgctggagaagcaggtgttccattctttagtatctcaggttctgactttgtagaaatgtttgtcggagttggagctagtcgtgttcgctctctttttgaggatgccaaaaaagcagcaccagctatcatctttatcgatgaaattgatgctgttggacgtcaacgtggagtcggtctcggcggaggtaatgacgaacgtgaacaaaccttgaaccaacttttgattgagatggatggttttgagggaaatgaagggattatcgtcatcgctgcgacaaaccgttcagatgtacttgaccctgcccttttgcgtccaggacgttttgatagaaaagtattggttggtcgtcctgatgttaaaggtcgtgaagcaatcttgaaagttcacgctaagaataagcctttagcagaagatgttgatttgaaattagtggctcaacaaactccaggctttgttggtgctgatttagagaatgtcttgaatgaagcagctttagttgctgctcgtcgcaataaatcgataattgatgcttcagatattgatgaagcagaagatagagttattgctggaccttctaagaaagataagacagtttcacaaaaagaacgagaattggttgcttaccatgaggcaggacataccattgttggtctagtcttgtcgaatgctcgcgttgtccataaggttacaattgtaccacgcggccgtgcaggcggatacatgattgcacttcctaaagaggatcaaatgcttctatctaaagaagatatgaaagagcaattggctggcttaatgggtggacgtgtagctgaagaaattatctttaatgtccaaaccacaggagcttcaaacgactttgaacaagcgacacaaatggcacgtgcaatggttacagagtacggtatgagtgaaaaacttggcccagtacaatatgaaggaaaccatgctatgcttggtgcacagagtcctcaaaaatcaatttcagaacaaacagcttatgaaattgatgaagaggttcgttcattattaaatgaggcacgaaataaagctgctgaaattattcagtcaaatcgtgaaactcacaagttaattgcagaagcattattgaaatacgaaacattggatagtacacaaattaaagctctttacgaaacaggaaagatgcctgaagcagtagaagaggaatctcatgcactatcctatgatgaagtaaagtcaaaaatgaatgacgaaaaataa

SEQ ID NO: 234 - DNA, 1278 bp, Streptococcus pneumoniae
atgagggaaccagattttttaaatcattttctcaagaagggatatttcaaaaagcatgctaaggcggttctagctctttctggtggattagattccatgtttctatttaaggtattgtctacttatcaaaaagagttagagattgaattgattctagctcatgtgaatcataagcagagaattgaatcagattgggaagaaaaggaattaaggaagttggctgctgaagcagagcttcctatttatatcagcaatttttcaggagaattttcagaagcgcgtgcacgaaattttcgttatgatttttttcaagaggtcatgaaaaagacaggtgcgacagctttagtcactgcccaccatgctgatgatcaggtggaaacgatttttatgcgcttgattcgaggaactcgcttgcgctatctatcaggaattaaggagaagcaagtagtcggagagatagaaatcattcgtcccttcttgcattttcagaaaaaagactttccatcaatttttcactttgaagatacatcaaatcaggagaatcattattttcgaaatcgtattcgaaattcttacttaccagaattggaaaaagaaaatcctcgatttagggatgcaatcttaggcattggcaatgaaattttagattatgatttggcaatagctgaattatctaacaatattaatgtggaagatttacagcagttattttcttactctgagtctacacaaagagttttacttcaaacttatctgaatcgttttccagatttgaatcttacaaaagctcagtttgctgaagttcagcagattttaaaatctaaaagccagtatcgtcatccgattaaaaatggctatgaattgataaaagagtaccaacagtttcagatttgtaaaatcagtccgcaggctgatgaaaaggaagatgaacttgtgttacactatcaaaatcaggtagcttatcaaggatatttattttcttttggacttccattagaaggtgaattaattcaacaaatacctgtttcacgtgaaacatccatacacattcgtcatcgaaaaacaggagatgttttgattaaaaatgggcatagaaaaaaactcagacgtttatttattgatttgaaaatccctatggaaaagagaaactctgctcttattattgagcaatttggtgaaattgtctcaattttgggaattgcgaccaataatttgagtaaaaaaacgaaaaatgatataatgaacactgtactttatatagaaaaaatagataggtaa

SEQ ID NO: 235 - DNA, 1692 bp, Streptococcus pneumoniae
atgaagcgttcttctcttttagttagaatggttatttccatctttctggtctttctcattctcctagctctggttggaactttctactatcaatcaagttcttcagccattgaggccaccattgagggcaacagccaaacgaccatcagccagactagccactttattcagtcttatatcaaaaaactagaaaccacctcgactggtttgacccagcagacggatgttctggcctatgctgagaatcccagtcaagacaaggtcgagggaatccgagatttgtttttgaccatcttgaagtcagataaggacttgaaaactgttgtgctggtgaccaaatctggtcaggtcatttctacagatgacagtgtgcagatgaaaacttcctctgatatgatggctgaggattggtaccaaaaggccattcatcagggagctatgcctgttttgactccagctcgtaaatcagatagtcagtgggtcatttctgtcactcaagaacttgttgatgcaaagggagccaatcttggtgtgcttcgtttggatatttcttatgaaactctggaagcctatctcaatcaactccagttggggcagcagggctttgccttcattatcaatgaaaaccatgaatttgtctaccatcctcaacacacagtttatagttcgtctagcaaaatggaggctatgaaaccctacatcgatacaggtcagggttatactcctggtcacaaatcctacgtcagtcaagagaagattgcaggaactgattggacggtgcttggcgtgtcatcattggaaaagttagaccaggttcggagtcagctcttgtggaccttgcttggggccagtgtcacatctcttcttgtctgtctctgcttagtgtggttcagtcttaaacgctggattgctcctttgaaggatttgagagaaaccatgttggaaattgcttctggtgctcaaaatcttcgtgccaaggaagttggtgcctatgaactgagagaagtaactcgccaatttaatgctatgttggatcagattgatcagttgatggtagctattcgtagccaggaagaaacgacccgtcagtaccaacttcaagccctttcgagccagattaatccacatttcctctataacactttggacaccatcatctggatggctgaatttcatgatagtcagcgagtggtgcaggtgaccaagtccttggcaacctatttccgcttggcgctcaatcaaggcaaggacttgatttgtctctctgacgaaatcaatcatgtccgccagtatctctttatccagaaacaacgctatggagataagctggaatacgaaattaatgaaaatgttgcctttgataatttagtcttacccaagctggtcctacaaccccttgtagaaaatgctctttaccatggcattaaggaaaaggaaggtcagggccatattaaactttctgtccagaaacaggattcgggattggtcatccgtattgaggatgatggcgttggcttccaagatgctggtgatagtagtcaaagtcaactcaaacgtgggggagttggtcttcaaaatgtcgatcaacggctcaaacttcattttggagccaattaccatatgaagattgattctagaccccaaaaagggacgaaagttgaaatatatataaatagaatagaaactagctaa

SEQ ID NO: 236 - DNA, 1692 bp, Streptococcus pneumoniae; identical to SEQ ID NO: 235

SEQ ID NO: 237 - DNA, 1140 bp, Streptococcus pneumoniae
atgttttttaaattattaagagaagctcttaaagtcaagcaggttcgatcaaaaattttatttacaatttttatcgttttggtctttcgtatcggaactagcattacagttcctggtgtgaatgccaatagcttgaatgctttaagtggattatccttcttaaacatgttgagcttggtgtcggggaatgccctaaaaaacttttcgatttttgccctaggagttagtccctatatcaccgcttctattgttgtccaactcttgcaaatggatattttacccaagtttgtagagtggggtaaacaaggggaagtaggtcgaagaaaattgaatcaagctactcgttatattgctctagttctcgcttttgtgcaatctatcgggattacagctggttttaataccttggctggagctcaattgattaaaactgctttaactccacaagtttttctgacgattggtatcatcttaacagctggtagtatgattgtcacttggttgggtgagcaaattacagataagggatacggaaacggtgtttccatgattatctttgccgggattgtttcctcaattccagagatgattcagggcatctatgtggactactttgtgaacgtcccaagtagccgtatcacttcatctatcattttcgtaatcattttgattattactgtattgttgattatttactttacaacttatgttcaacaagcagaatacaaaattccaatccaatatactaaggttgcacaaggtgctccatctagctcttaccttccgttaaaagtaaaccctgctggagttatccctgttatctttgccagttcgattactgcagcgcctgcggctattcttcagtttttgagtgccacaggtcatgattgggcttgggtaagggtagcacaagagatgttggcaactacttctccaactggtattgccatgtatgctttgttgattattctctttacattcttctatacgtttgtacagattaatcctgaaaaagcagcagagacctacaaaagagtggtgcctatatccatggagttcgtcctggtaaaggtacagaagaatatatgtctaaacttcttcgtcgtcttgcaactgttggttccctcttccttggtgtga

SEQ ID NO: 238 - DNA, 1338 bp, Streptococcus pneumoniae
atggatattagacaagttactgaaaccatcgccatgattgaggagcaaaacttcgatattagaaccattaccatggggatttctcttttggactgtatcgatccagatatcaatcgtgctgcggagaaaatctatcaaaaaattacgacaaaggcggctaatttagtagctgttggtgatgaaattgcggctgagttgggaattcctatcgttaataagcgtgtatcggtgacacctatttctctgattggggcagcgacagatgcgacggactacgtggttctggcaaaagcgcttgataaggctgcgaaagagattggtgtggactttattggtggtttttctgccttagtacaaaaaggttatcaaaagggagatgagattctcatcaattccattcctcgcgctttggctgagacggataaggtctgctcgtcagtcaatatcggctcaaccaagtctggtattaatatgacggctgtggcagatatgggacgaattatcaaggaaacagcaaatctttcagatatgggagtggccaagttggttgtattcgctaatgctgttgaggacaatccatttatggcgggtgcctttcatggtgttggggaagcagatgttatcatcaatgtcggagtttctggtcctggtgttgtgaaacgtgctttggaaaaagttcgtggacagagctttgatgtagtagccgaaacagttaagaaaactgcctttaaaatcactcgtatcggtcaattggttggtcaaatggccagtgagagactgggtgtggagtttggtattgtggacttgagtttggcaccaacccctgcggttggagactctgtggcacgtgtccttgaggaaatggggctagaaacagttggcacgcatggaacgacggctgccttggccctcttgaacgaccaagttaaaaagggtggagtgatggcctgcaaccaagtcggtggtttatctggtgcctttatccctgtttctgaggatgaaggaatgattgctgcagtgcaaaatggctctcttaatttagaaaaactagaagctatgacggctatctgttctgttggattggatatgattgccatcccagaagatacgcctgctgaaactattgcggctatgattgcggatgaagcagcaatcggtgttatcaacatgaaaacaacagctgttcgtatcattcccaaaggaaaagaaggcgatatgattgagtttggtggtctattaggaactgcacccgttatgaaggttaatggggcttcgtctgtcgacttcatctctcgcggtggacaaatcccagcaccaattcatagttttaaaaattaa

SEQ ID NO: 239 - DNA, 858 bp, Streptococcus pneumoniae
atgacacagattattgatgggaaagctttagcggccaaattgcaggggcagttggctgaaaagactgcaaaattaaaggaagaaacaggtctagtgcctggtttggtagtgattttggttggggacaatccagccagccaagtctacgttcgcaacaaggagaggtcagcccttgcggctggtttccgtagcgaagtagtacgggttccagagaccattactcaagaggaattgttagacctgattgctaaatacaatcaggatccagcttggcatgggattttggttcagttgccattaccaaaacacattgatgaagaggcggttctattggctattgacccagaaaaggatgtggatggtttccatcctctaaacatggggcgtctttggtctggtcatccagtcatgattccttcgacaccggcaggaattatggaaatgttccatgaatatgggattgacttggaaggtaaaaatgcagtcgtcatcggtcgatccaatattgtcggaaaacctatggcccagcttcttttggcaaagaatgcaacagtaaccttgactcactcacgtactcataatctttccaaggtggctgcaaaagcagatattctggttgttgcaatcggtcgtgccaagtttgtgactgctgactttgtcaaaccaggtgcggtagtcattgacgttgggatgaaccgcgatgaaaatggtaagctctgtggggatgttgattatgaggcggttgccccacttgctagccacattacgccagtccctggaggtgtcggtcctatgaccattactatgctgatggagcaaacctatcaggcagcacttaggacattggatagaaaataa

SEQ ID NO: 240 - DNA, 1212 bp, Streptococcus pneumoniae
atgtctaaatttaatcgtattcatttggtggtactggattctgtaggaatcggtgcagcaccagatgctaataactttgtcaatgcaggggttccagatggagcttctgacacactgggacacatttcaaaaacagttggtttgaatgtcccaaacatggctaaaataggtcttggaaatattcctcgtgaaactcctcttaagactgtagcagctgaaagcaatccaactggatatgcaacaaaattagaggaagtatctcttggtaaggatactatgactggacactgggaaatcatgggactcaacattactgagcctttcgatactttctggaacggattcccagaagaaatcctgacaaaaatcgaagaattctcaggacgcaaggttattcgtgaagccaacaaaccttattcaggaacggctgttatctatgattttggaccacgtcagatggaaactggagagttgattatctatacttcagctgaccctgttttgcagattgctgcccacgaagacattattcctttggatgaattgtaccgtatctgtgaatacgctcgttcgattacccttgagcgtcctgcccttcttggtcgcatcattgctcgcccttatgtaggtgaaccaggtaacttcactcgtacggcaaaccgtcgtgacttggctgtatctccatttttcccaactgttttggataaattgaatgaggctggtatcgatacttatgctgtgggtaaaatcaacgatatctttaacggtgctggtatcaaccatgacatgggtcacaacaagtcaaatagtcatggaattgatacactattgaagactatgggacttgctgagtttgaaaaaggattctcattcacaaacctagttgactttgatgccctttacggccatcgtcgtaatgctcacggttaccgtgattgcttgcatgagtttgatgaacgcttacctgaaattatcgcagctatgagagagaatgaccttctcttgattactgcggaccatggaaatgacccaacgtatgcaggaacggatcacactcgggaatatattccattgttggcctatagccctgcctttaaaggaaatggtctcattccagtaggacattttgcagatatttcagcgactgttgccgataactttggtgtggaaactgctatgattggggaaagtttcttagataaattggtataa

SEQ ID NO: 241 - DNA, 981 bp, Streptococcus pneumoniae
atgtttatttccatcagtgctggaattgtgacatttttactaactttagtagaaattccggcctttatccaattttatagaaaggcgcaaattacaggccagcagatgcatgaggatgtcaaacagcatcaggcaaaagctgggactcctacaatgggaggtttggttttcttgattacttctgttttggttgctttctttttcgccctatttagtagccaattcagcaataatgtgggaatgattttgttcatcttggtcttgtatggcttggtcggatttttagatgactttctcaaggtctttcgtaaaatcaatgaggggcttaatcctaagcaaaaattagctcttcagcttctaggtggagttatcttctatcttttctatgagcgcggtggcgatatcctgtctgtctttggttatccagttcatttgggatttttctatattttcttcgctcttttctggctagtcggtttttcaaacgcagtaaacttgacagacggtgttgacggtttagctagtatttccgttgtgattagtttgtctgcctatggagttattgcctatgtgcaaggtcagatggatattcttctagtgattcttgccatgattggtggtttgctcggtttcttcatctttaaccataagcctgccaaggtctttatgggtgatgtgggaagtttggccctaggtgggatgctggcagctatctctatggctctccaccaagaatggactctcttgattatcggaattgtgtatgtttttgaaacaacttctgttatgatgcaagtcagttatttcaaactgacaggtggtaaacgtattttccgtatgacgcctgtacatcaccattttgagcttgggggattgtctggtaaaggaaatccttggagcgagtggaaggttgacttcttcttttggggagtgggacttctagcaagtctcctgaccctagcaattttatatttgatgtaa

SEQ ID NO: 242 - DNA, 1281 bp, Streptococcus pneumoniae
ttgtttaagaaaaataaagacattcttaatattgcattgccagctatgggtgaaaactttttgcagatgctaatgggaatggtggacagttatttggttgctcatttaggattgatagctatttcaggggtttcagtagctggtaatattatcaccatttatcaggcgattttcatcgctctgggagctgctatttccagtgttatttcaaaaagcatagggcagaaagaccagtcgaagttggcctatcatgtgactgaggcgttgaagattaccttactattaagtttccttttaggatttttgtccatcttcgctgggaaagagatgataggacttttggggacggagagggatgtagctgagagtggtggactgtatctatctttggtaggcggatcgattgttctcttaggtttaatgactagtctaggagccttgattcgtgcaacgcataatccacgtctgcctctctatgttagttttttatccaatgccttgaatattcttttttcaagtctagctatttttgttctggatatggggatagctggtgttgcttgggggacaattgtgtctcgtttggttggtcttgtgattttgtggtcacaattaaaactgccttatgggaagccaacttttggtttagataaggaactgttgaccttggctttaccagcagctggagagcgacttatgatgagggctggagatgtagtgatcattgccttggtcgtttcttttgggacggaggcagttgctgggaatgcaatcggagaagtcttgacccagtttaactatatgcctgcctttggcgtcgctacggcaacggtcatgctgttggcccgagcagttggagaggatgattggaaaagagttgctagtttgagtaaacaaaccttttggctttctctgttcctcatgttgcccctgtcctttagtatatatgtcttgggtgtaccattaactcatctctatacgactgattctctagcggtggaggctagtgttctagtgacactgttttcactacttgggacccctatgacgacaggaacagtcatctatacggcagtctggcagggattaggaaatgcacgcctccctttttatgcgacaagtataggaatgtggtgtatccgcattgggacaggatatctgatggggattgtgcttggttggggcttgcctggtatttgggcagggtctctcttggataatggttttcgctggttatttctacgctatcgttaccagcgctatatgagcttgaaaggatag

SEQ ID NO: 243 - DNA, 1263 bp, Streptococcus pneumoniae
atgcaaactcaagaaaaacactcgcaagcagccgttcttggcttgcagcacttactagccatgtactcaggatctatcctggttcccatcatgattgcgacagcccttggctattcagctgagcagttgacctacctgatttctacagatatcttcatgtgtggggtggcaaccttcctccaactccaactcaacaaatactttgggattggactcccagtcgttcttggagttgcattccagtcggtcgctcccttgattatgattgggcaaagccatggtagtggcgctatgtttggtgcccttatcgcatctgggatttacgtggttcttgtttcaggcatcttctcaaaagtagccaatctcttcccatctatcgtaacaggatctgttattaccacgattggtttaaccttgatccctgtcgctattggaaatatgggaaataacgttccagagccaactggtcaaagtctcttgcttgcagctattactgttctgattatcctcttgatcaacatctttaccaaaggatttatcaagtctatctctattttgattggtctggttgttggaactgccattgctgctactatgggcttggtggacttctctcctgttgcggtagctccacttgtccatgtcccaactccactctactttgggatgccaacctttgaaatctcatctattgtcatgatgtgtatcatcgcaacggtgtctatggttgagtcaactggtgtttatctggccttgtctgatatcacaaaggatccaatcgacagcacgcgccttcgcaacggataccgcgcagaaggtttggccgtacttctcggaggaatctttaacaccttcccttacaccggattttcacaaaacgttggtttggttaaattgtcaggcatcaaaaaacgcctgccaatctactacgcagctggtttcctggttctccttggactgcttcctaagtttggcgcccttgcccaaatcattccaagctccgtcctcggtggtgccatgctggtaatgtttggttttgtatcaattcaagggatgcaaatcctcgcccgtgttgactttgctaacaatgaacacaacttccttatcgcagctgtttcaatcgctgcaggtgtcggtctcaacaacagtaatctctttgtcagcatgccgacagccttccaaatgttcttctcaaacggaatcgtcgtagccagcctactcgctattgtcctcaatgccgtattaaatcataaaaagaaataa

SEQ ID NO: 244 - DNA, 2355 bp, Streptococcus pneumoniae
atgaaagatagaataaaagaatatttacaagacaagggaaaggtgactgttaatgatttggctcaggctttgggaaaagacagttccaaggattttcgtgagttgattaaaaccttgtccttaatggaaagaaagcaccaaattcgttttgaagaagatggtagtctgacattagaaattaagaaaaaacatgagattaccctcaaggggatttttcatgcccataaaaatggctttggctttgttagtctggaaggcgaggaggacgacctttttgtagggaaaaatgatgtcaactatgctattgatggtgataccgtcgaggtagtgattaagaaagtcgctgaccgcaataagggaacagcagcagaagccaaaattattgatatcctagaacacagtttgacaacagttgtcgggcaaatcgttctggatcaggaaaaacctaagtatgctggctatattcgttcaaaaaatcagaaaatcagtcaaccgatttatgttaagaaaccagccctaaaattagaaggaacagaagttctcaaagtctttatcgataaatacccaagcaagaaacatgatttctttgtcgcgagtgttctcgatgtagtgggacactcaacggatgtcggaattgatgttcttgaggtcttggaatcaatggacattgtatccgagtttccagaagctgttgttaaggaagcagaaagtgtgcctgatgctccgtctcaaaaggatatggaaggtcgtctggatctaagagatgaaattacctttaccattgacggtgcggatgccaaggacttggacgatgcagtgcatatcaaggctctgaaaaatggcaatctggagtttggggttcacatcgcagatgtttcttattatgtgaccgaggggtctgcccttgacaaggaagcccttaaccgtgcgacttctgtttacgtgacagaccgagtggtgccaatgcttccagaacgactatcaaatggcatctgctctctcaatccccaagttgaccgcctgacccagtctgctattatggagattgataaacatggtcgtgtggtcaactataccattacacaaacagttatcaagaccagttttcgtatgacctatagcgatgtcaatgatatcctagctggcgatgaagaaaagagaaaagaatatcataaaattgtatcaagtatcgaactcatggccaagcttcatgaaactttagaaaacatgcgtgtgaaacgtggagctctcaattttgataccaatgaagcgaagattttagtggataaacaaggtaagcctgttgatatcgttcttcggcagcgtggtattgccgagcggatgattgagtcttttatgttgatggctaatgaaacagttgccgaacatttcagcaagttggatttgccttttatctatcgaattcacgaggagcctaaggctgaaaaggttcagaagtttattgattatgcttcgagttttggcttgcgcatttatggaactgccagtgagattagtcaggaggcacttcaagacatcatgcgtgctgttgagggagaaccttatgcagatgtattgtccatgatgcttcttcgctctatgcagcaggctcgttattcggagcacaatcacggccactatggactagctgctgactattatactcactttaccagtccaattcgtcgttatccagaccttcttgttcaccgtatgattcgggattacggccgttctaaggaaatagcagagcattttgaacaagtgattccagagattgcgacccagtcttccaaccgtgaacgtcgtgccatagaagctgagcgtgaagtcgaagccatgaaaaaggctgagtatatggaagaatacgtgggtgaagagtatgatgcagttgtatcaagtattgtcaaattcggtctctttgtcgaattgccaaacacagttgaaggcttgattcacatcactaatctgcctgaattttatcatttcaatgagcgtgatttgactcttcgtggagaaaaatcaggtatcactttccgagtgggtcagcagatccgtatccgtgttgaaagagcggataaaatgactggagagattgatttttcattcgtacctagtgagtttgatgtgattgaaaaaggcttgaaacagtctagtcgtagtggcagagggcgtgattcaaatcgtcgttcggataagaaggaagacaagagaaaatcaggacgctcaaatgataagcgtaagcattcacaaaaagacaagaagaaaaaaggaaagaaacctttttacaaggaagtagctaagaaaggagccaagcatggcaaagggcgagggaaaggtcgtcgcacaaaataa

SEQ ID NO: 245 - DNA, 1542 bp, Streptococcus pneumoniae; identical to SEQ ID NO: 205

SEQ ID NO: 246 - DNA, 1455 bp, Streptococcus pneumoniae
atgaaatttagtaaaaaatatatagcagctggatcagctgttatcgtatccttgagtctatgtgcctatgcactaaaccagcatcgttcgcaggaaaataaggacaataatcgtgtctcttatgtggatggcagccagtcaagtcagaaaagtgaaaacttgacaccagaccaggttagccagaaagaaggaattcaggctgagcaaattgtaatcaaaattacagatcagggctatgtaacgtcacacggtgaccactatcattactataatgggaaagttccttatgatgccctctttagtgaagaactcttgatgaaggatccaaactatcaacttaaagacgctgatattgtcaatgaagtcaagggtggttatatcatcaaggtcgatggaaaatattatgtctacctgaaagatgcagctcatgctgataatgttcgaactaaagatgaaatcaatcgtcaaaaacaagaacatgtcaaagataatgagaaggttaactctaatgttgctgtagcaaggtctcagggacgatatacgacaaatgatggttatgtctttaatccagctgatattatcgaagatacgggtaatgcttatatcgttcctcatggaggtcactatcactacattcccaaaagcgatttatctgctagtgaattagcagcagctaaagcacatctggctggaaaaaatatgcaaccgagtcagttaagctattcttcaacagctagtgacaataacacgcaatctgtagcaaaaggatcaactagcaagccagcaaataaatctgaaaatctccagagtcttttgaaggaactctatgattcacctagcgcccaacgttacagtgaatcagatggcctggtctttgaccctgctaagattatcagtcgtacaccaaatggagttgcgattccgcatggcgaccattaccactttattccttacagcaagctttctgccttagaagaaaagattgccagaatggtgcctatcagtggaactggttctacagtttctacaaatgcaaaacctaatgaagtagtgtctagtctaggcagtctttcaagcaatccttcttctttaacgacaagtaaggagctctcttcagcatctgatggttatatttttaatccaaaagatatcgttgaagaaacggctacagcttatattgtaagacatggtgatcatttccattacattccaaaatcaaatcaaattgggcaaccgactcttccaaacaatagtctagcaacaccttctccatctcttccaatcaatccaggaacttcacatgagaaacatgaagaagatggatacggatttgatgctaatcgtattatcgctgaagatgaatcaggttttgtcatgagtcacggagaccacaatcattatttcttcaagaaggacttgacagaagagcaaattaaggtgcgcaaaaacatttag

SEQ ID NO: 247 - DNA, 462 bp, Streptococcus pneumoniae
atgaaaaaaagagcaatagtggcagtcattgtactgcttttgattgggctggatcagttggtcaaatcctatatcgtccagcagattccactgggtgaagtgcgctcctggatccccaatttcgttagcttgacctacctgcaaaatcgaggtgcagccttttctatcttacaagatcagcagctgttattcgctgtcattactctggttgtcgtgataggtgccatttggtatttacataaacacatggaggactcattctggatggtcttgggtttgactctaataatcgcgggtggtcttggaaactttattgacagggtcagtcagggctttgttgtggatatgttccaccttgactttatcaactttgcaattttcaatgtggcagatagctatctgacggttggagtgattattttattgattgcaatgctaaaagaggaaataaatggaaattaa

SEQ ID NO: 248 - DNA, 855 bp, Streptococcus pneumoniae
atgaatacaaatcttgcaagttttatcgttggactgatcatcgatgaaaacgaccgtttttactttgtgcaaaaggatggtcaaacctatgctcttgctaaggaagaaggccaacatacagtaggggatacggtcaaaggttttgcatacacggatatgaagcaaaaactccgcctgacaaccttagaagtgactgccactcaggaccaatttggttggggacgtgtcacagaggttcgtaaggacttgggtgtctttgtggatacaggccttcctgacaaggaaatcgttgtgtcactcgatattctccctgagctcaaggaactctggcctaagaagggcgaccaactctacatccgtcttgaagtggataagaaagaccgtatctggggcctcttggcttatcaagaagacttccaacgtcttgctcgtcctgcctacaacaacatgcagaaccaaaactggccagccattgtttaccgtctcaagctgtcaggaacttttgtttacctaccagaaaataatatgcttggttttattcatcctagcgagcgttacgcagagccacgtttggggcaagtattagatgcgcgcgttattggtttccgtgaagtggaccgcactctgaacctctccctcaaaccacgctcctttgaaatgttggaaaacgatgctcagatgattttgacttatttggaaagcaatggcggtttcatgaccttaaatgacaagtcatctccagacgacatcaaggcaacctttggcatttctaaaggtcagttcaagaaagctttaggtggtcttatgaaggctggtaaaatcaagcaggaccagtttgggacagagttgatttag

SEQ ID NO: 249 - DNA, 1185 bp, Streptococcus pneumoniae
atgaaagatgttagtctatttttattgaaaaaagttttcaaaagccgcttaaactggattgtcttagctttatttgtatctgtactcggtgttaccttttatttaaatagtcagactgcaaactcacacagcttggagagcaggttggaaagtcgcattgcagccaacgagagggctatcaatgaaaatgaagagaaactctcccaaatgtctgataccagctcggaggaataccagtttgctaaaaataatttagacgtgcaaaaaaatcttttgacgcgaaagacagaaattctgactttattaaaagaagggcgctggaaagaagcctactatttgcagtggcaagatgaagagaagaattatgaatttgtatcaaatgacccgactgctagccctggcttaaaaatgggggttgaccgcgaacggaagatttaccaagccctgtatcccttgaacataaaagcacatactttggagtttccgacccacgggattgatcagattgtctggattttagaggttatcatcccaagtttgtttgtggttgctattatttttatgctaacacaactatttgcagaaagatatcaaaatcatctggacacagctcacttatatcctgtttcaaaagtgacatttgcaatatcctctcttggagttggagtgggatatgtaactgtgctgtttatcggaatctgtggcttttcttttctagtgggaagtctgataagtggttttggacagttagattatccctacccaatttatagcttagtgaatcaagaagtaactattgggaaaatacaagatgtattatttcctggcttgctcttagctttcttagcctttatcgtcattgtggaagttgtgtacttgattgcttactttttcaagcaaaaaatgcctgtcctctttctttcactcattgggattgttggcttattgtttggtatccaaaccattcagcctcttcaaaggattgcacatctgattccctttacttacttgcgttcagtggagattttatctggaagattacctaagcagattgataatgtcgatctaaattggagcatgggaatggtcttacttccttgcctgattatctttttgctattgggaattctatttattgaaagatggggaagttcacagaaaaaagaattttttaatagattctag

SEQ ID NO: 250 - DNA, 1347 bp, Streptococcus pneumoniae
atgatgaagttcatattggatattgttagtacaccagctattttagtagctttaattgcaatcttaggattagttcttcagaagaagaaattacctgatattattaaaggtggaattaagacctttgttggtttcttagttgtatctggtggtgcaggaattgtacaaaattctttaaatccatttggtaccatgtttgagcatgcttttcatttatctggcgttgtgccgaataatgaagcaattgtagctgtagctttaacaacatatggctcagctactgcaatgattatgtttgcaggcatggtgttcaatatcttaatcgctcgttttactcgatttaaatatatttttttaacagggcaccacactctatatatggcatgtatgattgcggtcattttatcagttgctggctttactagcttgcctctcatcttactaggaggattagcactcggtattattatgagtatttccccagcatttgtgcaaaaatatatggttcaattaactggaaatgacaaggtagctttaggtcatttcagttctttgggatattggttgagtggttttactggtagccttatcggtgacaaatcaaaatcaacagaggacattaaatttccaaagagtttagcttttttacgtgatagtactgttagtattactttatccatggcagttatttacattattgtagctatctttgcagggtcagaatatatagaaaaagaaatcagtagtggtacaagtggtctagtttatgctttacaattagcaggtcaatttgcagcaggggtatttgttattttagcaggtgttcgccttattttgggcgaaattgttccagcctttaaaggtatttcagagcgtcttgtacctaattcaaaacctgctttggattgtccgattgtttatacttatgcacccaatgcagttctaattggatttatctctagttttgttggtggtttagtaagtatggtaattatgattgcttcaggaacggttgttatcttaccaggtgttgtgcctcatttcttctgtggagcgactgcaggtgtcattgggaatgcatctggtggtgttcgtggagccactattggagcatttttacaaggtattttaatcagttttcttccagtctttttaatgccagttttgggaggacttggtttccaaggatcaactttctcagatgcagattttggtctatcaggaattattttaggaatgttaaatcaatttggctcacaagcaggcattgtgattggtcttgttcttattctagcagttatgtttggagtatcctttattaaaaagccatctgcaacggaggaataa

SEQ ID NO: 251 - DNA, 1002 bp, Streptococcus pneumoniae
atgattaaaacatttctctctgccctttcggtcattctcttttctatccctatcataacttattcttttttcccatcttctaatcttaacatttggctatctacccaacctatcttggcacagatttatgccttccccttagctactgcaactatggctgctattttaagtttcttattttttttcctatctttttacaagaaaaataaacaaatacggttttactctggcattttgctcttactatcgctcatattactattattcggaacagataaaaccctttcttctgcatcaaataagactaaaaccttaaaattagtaacttggaacgtcgctaatcaaatagaagcacaacatattgagcgaatttttagccattttgacgccgatatggctatattccctgaactagctaccaatatcagaggtgagcaagaaaaccagagaatcaaactattgtttcatcaagttggactttctatggccaactatgatattttcacttctccacctaccaatagtggaatagctcctgtgactgtgattgtcaagaaaagttatggtttctatacagaagctaaaacttttcatacaacacggttcgggacaattgtattacattcgagaaaacaaaatataccagatatcattgccttgcatactgcgcctcctctgccaggtttaatggaaatctggaagcaagacttaaacatcattcataatcaattggcttcaaaatatccaaaggctattattgcaggtgattttaatgcaactatgcgtcatggagcacttgcaaaaataagctctcatagggacgcattaaatgcactgccaccttttgaaagaggaacttggaatagccaaagtccaaaactttttaatgcaacaatagatcatattttattgcctaaaaaccactactatgttaaagatttagacattgtaagttttcaaaactctgatcatagatgtatttttacagaaatcacattttaa

SEQ ID NO: 252 - DNA, 1278 bp, Streptococcus pneumoniae
atgaatccaatccaaagatcttgggcttatgtcagcagaaagcgactgagaagttttattttatttctgattttattggtcttattggccggaatttcagcctgtttgactctgatgaagtccaacaaaacagtagaaagcaatctttataaatcactcaatacatctttttctattaagaagatagagaatggtcagacattcaagttgtcagacctagcatctgtaagcaagattaaggggctggaaaatgtctctcctgaacttgagacggtcgcaaaactaaaagacaaggaagcagtgactggcgagcagagcgtggagcgtgatgatttatcagctgcagacaataacttggttagcttaacggctcttgaggattcatccaaggatgtaacctttaccagttcggctttcaatctaaaagaagggcgacaccttcaaaaaggggattccaagaaaatccttatccacgaagaattggctaagaagaacggtctttcgcttcatgacaagattggcttggatgctggtcagtctgaatctggaaaaggacaaacagtagagtttgagattatcggcatcttttctggtaaaaaacaagagaaattcacaggcttgtcttctgacttcagtgaaaatcaagtctttacagactatgaaagtagccaaacccttttgggcaatagtgaagctcaagtcagtgcagcacgcttctatgtagaaaatcctaaggaaatggacggactcatgaagcaggtagaaaacttggccttggaaaatcaaggctaccaagtcgaaaaggaaaacaaggcttttgaacaaatcaaagactcagttgcaactttccaaaccttcctgaccatcttcctttatgggatgttgatagcaggagctggagccttaattctggttttgtctctctggttgagagaacgggtctatgaagtggggattttacttgcacttggaaaaggcaagagctcgatcttcctacaattctgtttagaggtagttttggtatctcttggagctttgcttccagcatttgttgcaggaaacgcaatcacaacttacctactccaaactctactagcaagtggagatcaggcaagcttacaagatacactagccaaagcaagcagtttatcaactagcatcttatcttttgcagaatcctatgtttttctagttctgcttagttgcttatctgtagccctttgtttcctattcttatttagaaaatcaccgaaagaaattttatcatctattagttaa

SEQ ID NO: 253 - DNA, 1380 bp, Streptococcus pneumoniae
atgttacacaacgcatttgcctatgttacaaggaagtttttcaaatcgattgtcatcttcctgattattctcctcatggcgagcttgagtttggtcggcttgtcaatcaagggagctactgccaaggcttctcaggagacctttaaaaatatcaccaatagcttctccatgcaaatcaatcgtcgcgtcaaccaaggaacgcctcgtggtgctgggaatatcaagggtgaagacatcaaaaaaatcaccgaaaacaaggccattgagtcttatgtcaaacgtatcaacgctatcggagatttgactggatatgacctgattgaaacgccagaaaccaagaagaatctcactgctgatcgtgccaagcgttttggaagtagcttgatgattacaggtgtcaatgactcctctaaagaagacaagtttgtctctggttcttataaactagtcgaaggagagcacttaaccaacgacgacaaggataaaatcctcttgcacaaggacttggcagccaaacacggctggaaagtaggggacaaggttaaactggactctaatatctacgatgcagataatgaaaaaggagccaaggaaacagttgaagtgacaatcaagggactctttgatggtcataataagtcagcagtaacctactcacaagaactttacgaaaacacagctattacagacattcacactgctgcaaaactttatggatacacagaagacacagccatttatggggacgcaaccttctttgtaacagcagacaagaacttggatgatgttatgaaagagttgaatggcatcagtggtatcaactggaagagctacacactcgtcaagagctcctctaactacccagctcttgagcaatctatctctggtatgtacaagatggccaacctcctcttctggggtagcttgagcttctcagttctcctccttgccctcttgctcagcctttggatcaacgcccgtcgcaaggaagtgggaattctcctctctatcggcctcaagcaggcaagtatcttgggtcaattcatcaccgaatctatcttgattgctatccctgctctagtttctgcttacttcctagctaattacactgcccgtgcaattggaaacactgtccttgccaatgtgacttcaggtgttgccaaacaggctagtaaggcggctcaagcctctaaccttggtggtggtgcagaagtagatggctttagcaagaccttgtcgagcctagacatttccattcagacatcagactttatcatcatttttgtccttgccttggttctagtggttctcgttatggcgcttgcttcaagcaatctccttagaaaacaaccaaaagagctcttgctggatggtgaataa

SEQ ID NO: 254 - DNA, 618 bp, Streptococcus pneumoniae
atgtcacaggataaacaaatgaaagctgtttctccccttctgcagcgagttatcaatatctcatcgattgtcggtggggttgggagtttgattttctgtatttgggcttatcaggctgggattttacaatccaaggaaaccctctctgcctttatccagcaggcaggcatctggggtccacctctctttatctttttacagattttacagactgtcgtccctatcattccaggggccttgacctcggtggctggggtctttatctacgggcacatcatcgggactatctacaactatatcggcatcgtgattggctgtgccattatcttttatctagtgcgcctatacggagctgcctttgtccagtctgtcgtcagcaagcgcacctacgacaagtacatcgactggctagataagggcaatcgttttgaccgcttctttatttttatgatgatttggcccattagcccagctgactttctctgtatgctggctgccctgaccaagatgagcttcaagcgctacatgaccatcatcattctgaccaaaccctttaccctcgtggtttatacctacggtctgacctatattattgactttttctggcaaatgctttga

SEQ ID NO: 255 - DNA, 1200 bp, Streptococcus pneumoniae
atgagaaatatgtgggttgtaatcaaggaaacctatcttcgacatgtcgagtcatggagtttcttctttatggtgatttcgccgttcctctttttaggaatctctgtaggaattgggcatctccaaggttcttctatggctaaaaataataaagtggcagtagtgacaacagtgccatctgtagcagaaggactgaagaatgtaaatggtgttaacttcgactataaagacgaagcaagtgccaaagaagcaattaaagaagaaaaattaaaaggttatttgaccattgatcaagaagatagtgttctaaaggcagtttatcatggcgaaacatcgcttgaaaatggaattaaatttgaggttacaggtacactcaatgaactgcaaaatcagcttaatcgttcaactgcttccttgtctcaagagcaggaaaaacgcttagcgcagacaattcaattcacagaaaagattgatgaagccaaggaaaataaaaagtttattcaaacaattgcagcaggtgccttaggattctttctttatatgattctgattacctatgcgggtgtaacagctcaggaagttgccagtgaaaaaggcaccaaaattatggaagtcgttttttctagcataagggcaagtcactatttctatgcgcggatgatggctctgtttctagtgattttaacgcatattgggatctatgttgtaggtggtctggctgccgttttgctctttaaagatttgccattcttggctcagtctggtattttggatcacttgggagatgctatctcactgaataccttgctctttattttgatcagtcttttcatgtacgtagtcttggcagccttcctaggatctatggtttctcgtcctgaggactcagggaaagccttgtcgcctttgatgattttgattatgggtggtttttttggagtgacagctctaggtgcagctggtgacaatctcctcttgaagattggttcttatattccctttatttcgaccttctttatgccgtttcgaacgattaatgactatgcggggggagcagaagcatggatttcacttgctattacagtgatttttgcggtggtagcaacaggatttatcggacgcatgtatgctagtctcgttcttcaaacggatgatttagggatttggaaaacctttaaacgtgccttatcttataaatag

SEQ ID NO: 256 - DNA, 714 bp, Streptococcus pneumoniae
atgacagaaaccattaaattgatgaaggctcatacttcagtgcgcaggtttaaagagcaagaaattccccaagtagacttaaatgagattttgacagcagcccagatggcatcatcttggaagaatttccaatcctactctgtgattgtggtacgaagtcaagagaagaaagatgccttgtatgaattggtacctcaagaagccattcgccagtctgctgttttccttctctttgtcggagatttgaaccgagcagaaaagggagcccgacttcataccgacaccttccaaccccaaggtgtggaaggtctcttgattagttcggtcgatgcagctcttgctggacaaaacgccttgttggcagctgaaagcttgggctatggtggtgtgattatcggtttggttcgatacaagtctgaagaagtggcagagctctttaacctacctgactacacctattctgtctttgggatggcactgggtgtgccaaatcaacatcatgatatgaaaccgagactgccactagagaatgttgtctttgaggaagaataccaagaacagtcaactgaggcaatccaagcttatgaccgtgttcaggctgactatgctggggcgcgtgcgaccacaagctggagtcagcgcctagcagaacagtttggtcaagctgaaccaagctcaactagaaaaaatcttgaacagaagaaattattgtag

SEQ ID NO: 257 - DNA, 606 bp, Streptococcus pneumoniae
atgttaaaacttattgctattgttggaacaaattcaaaacgttctacaaaccgtcaattgcttcaatacatgcaaaaacactttactgacaaagctgaaattgaacttgttgaaatcaaggccattcctgtcttcaacaaaccagctgacaagcaagtacctgctgaaatattggaaattgctgctaaaatcgaagaggcagatggcgttattatcggtactcctgagtatgatcactctattccagctgttttgatgagcgctcttgcttggttgtcttatggtatttacccacttttgaacaaaccaatcatgattacaggtgcttcttacggtacgcttggttcatctcgtgcccaattgcaacttcgtcaaatcttgaatgctcctgaaatcaaggcaaatgttcttccagatgaattcttgctctcacactctcttcaagcatttaacccaagtggcgacttggttgaccttgatgttatcaagaaattggatgccatctttgatgacttccgtatctttgtaaaaatcacagaaaaattacgtaatgcacaagaattacttcgcaaagatgctgaagactttgactgggaaaatttgtaa

SEQ ID NO: 258 - DNA, 843 bp, Streptococcus pneumoniae
atgaatacctatcaattaaataatggagtagaaattccagtattgggatttggaacttttaaggctaaggatggagaagaagcctatcgtgcagtgttagaagccttgaaggctggttatcgtcatattgatacggcggcgatttatcagaatgaagaaagtgttggtcaagcaatcaaagatagcggagttccacgtgaagaaatgttcgtaactaccaagctttggaatagtcagcaaacctatgagcaaactcgtcaagctttggaaaaatctatagaaaaactgggcttggattatttggatttgtatttgattcattggccgaacccaaaaccgctcagagaaaatgacgcatggaaaactcgcaatgcggaagtttggagagcgatggaagacctctatcaagaagggaaaatccgtgctatcggcgttagcaattttcttccccatcatttggatgccttgcttgaaactgcaactatcgttcctgcggtcaatcaagttcgcttggcgccaggtgtgtatcaagatcaagtcgtagcttactgtcgtgaaaagggaattttattggaagcttgggggccttttggacaaggagaactgtttgatagcaagcaagtccaagaaatagcagcaaatcacggaaaatcggttgctcagatagccttggcctggagcttggcagaaggatttttaccacttccaaaatctgtcacaacctctcgtattcaagctaatcttgattgctttggaattgaactgagtcatgaggagagagaaaccttaaaaacgattgctgttcaatcgggtgctccacgagttgatgatgtggatttctag

SEQ ID NO: 259 - DNA, 801 bp, Streptococcus pneumoniae
atgaggtgcaaaatgcttgatccaattgctattcaactaggacccctagccattcgttggtatgccttatgtattgtgacaggcttgattcttgcggtttatttgaccatgaaagaagcacctagaaagaagatcataccagacgatattttagattttatcttagtagcctttcccttggctattttaggagctcgtctctactatgttattttccgatttgattactatagtcagaatttaggagagatttttgccatttggaatggtggtttggccatttacggtggtttgataactggggctcttgtgctctatatctttgctgaccgtaaactcatcaatacttgggattttctagatattgcggcgcctagcgttatgattgctcaaagtttggggcgttggggtaatttctttaaccaagaagcttatggtgcaacagtggataatctggattatctacctggctttatccgtgaccagatgtatattgaggggagctaccgtcaaccgactttcctttatgagtctctatggaatctgcttggctttgccttgattctgatttttagacggaaatggaagagtctcagacgaggtcatatcacggccttttacttgatttggtatggtttcggtcgtatggttatcgaaggtatgcgaacagatagtctcatgttcttcggctttcgagtgtcccaatggctgtcagttgtccttatcggtctcggtataatgatcgttatttatcaaaatcgaaagaaggccccttactatattacagaggaggaaaactaa

SEQ ID NO: 260 - DNA, 390 bp, Streptococcus pneumoniae
atgggtaaattatcctcaatccttttaggaaccgtttcaggtgcagctcttgccttgtttttaacaagtgataagggcaaacaagtttgcagtcaggctcaagattttctagatgatttgagagaagatccggagtatgccaaggagcaagtctgtgaaaaactgacagaagttaaggagcaggctacagattttgttctgaaaacaaaagaacaggttgagtcaggtgaaatcactgtggacagtatacttgctcaaactaaatcctatgcttttcaagcgacagaagcatcaaaaaatcaattaaataatctcaaggagcaatggcaagaaaaagccgaagctcttgatgactcagaagagattgtgattgatataacagaagaataa

SEQ ID NO: 261 - DNA, 618 bp, Streptococcus pneumoniae
atgaaaactaaattgatcttttggggctctatgctctttctcctctccctctccatccttctgaccatttatctggcttggattttctatcctatggagattcagtggctaaacttaacgaatcgagtctatctaaaaccagaaaccattcaatacaattttcatatcttgatgaattatctgaccaatccttttagtcaggtcttacagatgcctgattttcgttcgtcagcagctggtctgcaccatttcgcagtggtcaagaatctctttcatttggttcagctagtagctctagtgacactgccaagtttctatgtctttgtcaataggattgtgaaaaaggactttttgtctctttatcgaaaaagtctcctggctctagtagtcttacctgtgatgattggacttgggggagttttgattggttttgaccaattctttactcttttccatcaaattctctttgtgggagatgatacctggctttttgatccagccaaggatcctgttattatgattttgccagagaccttctttcttcatgccttcctcctcttttttgccctctatgaaaacttctttggctatctgtatctgaaaagtcgtaggaagtga

SEQ ID NO: 262 - DNA, 1914 bp, Streptococcus pneumoniae
atgacttatcattttactgaagaatacgatattattgtaattggtgcgggacacgctggggttgaggcttccttggccgctagccgtatgggctgtaaggtcctgcttgcgaccatcaatattgaaatgctggctttcatgccttgtaatccctctatcggtggttctgccaaggggattgtcgtgcgtgaagtcgatgccctcggtggcgagatggccaaaaccattgacaagacttacatccagatgaagatgctaaacacagggaaggggccagctgtccgtgcccttcgtgcgcaggctgacaaggaactttactctaaggagatgcgcaagacggttgaaaaccaagaaaatctgacccttcgtcaaaccatgattgatgagattttggtggaagatggcaaggttgtcggtgtgcgtacagccacccatcaagaatatgctgctaaggctgttattgtgacgacagggactgctctccgtggggaaattatcatcggagacctcaagtactcatcaggtcctaaccacagcttggcttctattaacctagctgacaatctcaaggaactgggtctcgaaatcggtcgtttcaagacaggaacccctccacgtgtcaaggcttcttctatcaattacgatgtgacagaaattcagccaggagacgaagtgcctaatcatttctcatacacttcacgtgatgaggattatgtcaaggaccaagtaccatgctggttgacctataccaatggtaccagtcatgagattatccaaaacaacctccaccgtgcgcctatgtttacaggtgtggtcaagggagtggggcctcgttactgtccgtcgattgaagacaagattgtgcgctttgcggacaaggaacgtcaccaactcttccttgagccagaagggcgcaatactgaggaagtctatgtgcaaggactttcaaccagtctgcctgaggatgtccagcgtgacttggtgcattccatcaaaggtttggaaaatgcagagatgatgcggacaggttatgctattgagtatgatatggtcttgcctcatcagttgcgtgcgactttggaaaccaagaaaatctcaggtctcttcactgctggtcagacaaatggaacatcaggttacgaagaggcagcaggccaagggattatcgcgggtatcaatgcggctctgaaaatccaaggcaagcctgaattgattttgaagcgcagtgatggttatatcggggtgatgatcgacgacttggtgaccaagggaaccattgaaccctaccgtctcttgaccagtcgtgctgaataccgtctcattcttcgtcatgacaatgctgatatgcgcttgactgagatgggacgcgagattggccttgtggacgatgaacgctgggctcgttttgaaatcaagaaaaatcaatttgataatgagatgaagcgcctagacagtatcaaactcaagccagtcaaggaaaccaatgccaaggttgaggagatgggcttcaaacccttgaccgatgcagtgacagccaaggaattccttcgccgtccagaagtttcttaccaagatgtggtggccttcatcggaccagctgcagaagacttggatgacaagattatcgaattgattgaaacagaaatcaagtatgaaggctatatttccaaagccatggaccaggttgccaagatgaaacgcatggaagaaaaacgcattccggccaatatcgactgggatgacattgattctatcgcaaccgaagcccgtcagaagttcaaactcatcaatccagaaaccatcggccaagccagccgtatttcgggagtaaacccagcagatatttctattttgatggtgtatctggaaggtaaaaatcgtagtatttctaaaactcttcaaaaatcaaaatga

SEQ ID NO: 263 - DNA, 684 bp, Streptococcus pneumoniae
atgaaagtattagcttttgatacgtccagcaaggctctttctctggctattttagaggataagcaggttcttgccgagacgacgattaatattaagaaaaatcacagtattactcttatgcctgccatcgattttttgatggcaagtttggattggacacccaaggatttggaccgaatcgtggtagctgaagggccgggtagctatacaggcttgcgaattgcggtagcaactgctaagaccttagctcacaccctgaacatcgagttggttggtatgtcgagtctcttggctctggtgccccatcaacaagaaggtttgtttgtccccttgatggatgcgcgtcgcaataatgtttatgcaggattttatgaaaatgccaaacctgtcatggcagaagcgcacctatcttttgaagaggtgctagaaaaagtcaagggtactagtcaggtaacctttgtcggagaagttggcccctttgttgagcagattcaaaaacacttgccaaggactgattacaaagaaacattgcccaatgcagctaatctagctcttttggcctgggacaaggaagcagactccttgcatgattttgtgccgaattacctcaaacgagtcgaggctgaggaaaactggctcaagaaccataccgagtctggcgagtcttacattaaacgcctatga

SEQ ID NO: 264 - DNA, 438 bp, Streptococcus pneumoniae
atgatagaaatcaagcgaattcaacaacagcctgacctagctcaagccatctacgctgttatggcagctgtttacctagtcagtccttggactctggagcaaatccaagcagatctgtcccaagaccagacttggtatgcattggcttatgatggggcagaagtgattggatttctagctgtgcaggagaatctttttgaagcagaagtcctgcaaatcgctgtcaaaggagcttatcagggtcaggggattgcgtcagccttgtttgctcaattgccgacagacaaggaaattttcctcgaagtcagacagtcaaatcaacgagcgcaagcattttacaagaaagaaaagatgacagttatcgctgagcgaaaggcctactaccatgacccagtcgaggacgccattatcatgaagagagaaatagatgaaggatag

SEQ ID NO: 265 - DNA, 558 bp, Streptococcus pneumoniae
atgacaaaacaagtcttattagtggatgatgaagaacacattctgaaattgcttgactaccatttaagtaaggaaggcttttctactcaattggtgacaaatggacggaaggccttagctttggcagaaacagaaccctttgattttatcttgcttgatatcatgttaccacaattagatggcatggaagtttgtaagcggctgagagccaaaggcgtcaaaactccaattatgatggtttctgcgaaaagtgatgaatttgataaggttttggccttggaattaggggctgatgactacctgaccaagccttttagccctagagaattgctggcgcgtgtcaaggctgtcctcaggcgaactaaaggagaacaagaaggagatgattcagataatatcgctgacgattcttggctatttgggaccttgaaagtataccctgagcgtcatgaagtctacaaggcgaataagttactgagtttgaccccaaaagaatttgaaagcgataaaaatccgttttttgaagttttcaaagtttcgaaagtaaccgcccaataa

SEQ ID NO: 266 - DNA, 1437 bp, Streptococcus pneumoniae
atgactacttttaaagatggatttttatggggtggtgctgttgctgctcatcaacttgaaggtggatggcaagaaggtggcaagggaattagtgttgctgatgttatgactgctggtcgtcatggagtagctcgtgaaattactttgggagttttagagggtaaatattatccaaatcatgaggcgatagatttttatcaccgttataaagaagatatagcactttttgctgaaatgggattcaagtgcttccgtacctctattgcatggacacgtatctttccaaaaggtgatgagttagagccgaatgaagaaggattacagttttatgataatctttttgatgaatgcttaaagaatggtattgaacctgtcatcactctatctcattttgaaatgccttatcacttagtgaccgaatatggtggttggaaaaataggaaattgattgatttctttgctcgttttgcagaagtcgtatttaaacgttacaaagataaggttaaatattggatgactttcaatgaaatcaataatcaagcgaattatcaggaagattttgcaccatttactaactcaggtattgtatatgaggaaggtgataatagagaagcaattatgtatcaagcagcacattacgaattagttgcttctgcacgagctgtaaaaattggtcatgagattaatccagattttcaaataggttgtatgattgcgatgtgtccaatttatccagttacttgcaatcctaaggatatcttaatggcaatgaaagctatgcagaagcgttattattttgctgatgtgcatgttttaggtaaatatcctgagcatattttcaagtattgggaacgaaaaggtatttcagttgattttactgcccaggataaagaagatttacttggtgggactgtagattacattggtttcagttactatatgtcctttgctatcgactctcatcgtgaaaataatccttattttgattatcttgaaacagaagatttagtgaaaaataattatgttaaggcttctgaatgggagtggcaaattgatccagaaggtttgcgttatgcgttaaattggtttacagaccactatcacttaccactctttattgttgaaaatggttttggagctatagatcaagttgcagcagatggtatggtacatgatgattatagaattgaatatctaggtgcccatattcgtgaaatgaaaaaggctgtagttgaagatggtgttgatttaatgggttatactccatggggatgtattgatttggtttcagctggtaccggtgaaatgcggaaacgttatggctttatttatgtagataaagatgataatgggaagggaagttataatcgttccccgaaaaaatcttttggctggtataaggaagttatttcatctaacggtgaatcagtagaatag

SEQ ID NO: 267 - DNA, 1347 bp, Streptococcus pneumoniae
atggatcaacaaaacgggttgtttggttttcttgaaaaccatgttatgggaccaatgggcaaacttgctcagtttaaagtagtacgtgctatcacggctgcaggtatggctgctgtaccatttactattgtaggatcaatgtttttggtattcagtattttgccacaagctttctcattttggccaattgtggcagatattttctctgcttcatttgataaattcacatcactttacatggttgcaaactatgcgactatgggttctctatctctttatttcgttctatcacttgcatatgaattgacaaaaatttatgcagaggaagaagaactcaatatgaatcctcttaatggtgccttgcttgccttgatggcttttgtcatgacagtaccgcaaatcatttttgatggtggaatgatgaagactgtgacaagtctaaaagaaggtgcagtaattgcagatggatgggcaatgggaaatgtagtcgcacgttttgggacaacagggatttttaccgcaatcattatggcaattgtgactgttcttatttatcgtatgtgtgttaaacataattgggttattaaaatgcctgaagctgttccagaaggagtttctcgtggatttaccgctttggttccgggatttgttgttgcatttgttgttatctttatcaacggtcttcttgtagcaatgggaacagatatttttaaagtcattgcaattccatttggttttgtatccaatctgactaattcgtggattggtttaatgattatttatctattgactcaactactttggattgtaggtatccacggtgcgaacattgtttttgcatttgttagtccaattgctcttgctaacatggctgaaaatgctgctggcgggcacttcgctgttgcaggtgaattttctaatatgtttgtaattgcaggtggttctggtgcaactttaggactatgtttatatattgcttttgcctctaaatctgaacagcttaaagcaataggacgagcatctgtagttccagccttatttaatattaatgaaccattaatttttggattacctattatctataatccagccttggctataccatttattttagcaccaatggttactgctactatttattacgtagcgaattctctaaactttattaagccaattatcgcacaggttccatggccaactccagtagggattggagctttcttagggacagcagatcttcgagctgtattagttgctctagtatgtgcatttgcagcattcctagtctatcttccattcatccgtgtatatgatcaaaaattggtgaaagaagagcaaggtatctaa

SEQ ID NO: 268 - DNA, 1974 bp, Streptococcus pneumoniae
atgaaaaaattttatgtaagtccaatttttcctattctagtaggattgattgcgtttggagtcttatccactttcattatttttgttaataataatctgttgacggttttaattttgtttctttttgtaggaggctatgtttttttatttaagaaactgagagtgcattatacaaggagtgatgtagaacagatacagtatgtaaaccaccaagcggaagaaagtttgacagctctattggaacagatgcctgtaggtgttatgaaattgaatttatcttctggagaggttgagtggtttaatccctatgctgaattgattttgaccaaggaagatggtgattttgatttagaagctgttcaaacgattatcaaggcttcagtaggaaatccgtctacttatgccaagcttggtgagaagcgttatgctgttcatatggatgcttcttccggtgttttgtattttgtagatgtatccagggaacaagccataacagatgaattggtaacaagtagaccagtgattgggattgtctctgtggataattatgatgatttggaggatgaaacttctgagtcagatattagtcaaatcaatagttttgtagctaattttatatcagagttttcagaaaaacacatgatgttttctcgtcgggtaagtatggatcgattttatctatttactgactacacggtgcttgagggcttgatgaatgataaattttctgttattgatgctttcagagaagagtcgaaacagagacagttgcccttgaccttaagtatgggattttcttatggcgatggaaatcatgatgagatagggaaagttgctttgctcaatttgaacttggctgaagtacgtggtggcgaccaggtggttgttaaggaaaacgacgaaacgaaaaatccagtttattttggtggtgggtctgctgcttcaatcaagcgtacacggactcgtacgcgcgctatgatgacagctatttcagataagattcggagtgtagatcaggtttttgtagtcggtcacaaaaatttagacatggatgctttgggctctgctgtaggtatgcagttgttcgccagcaatgtgattgaaaatagctatgctctttatgatgaagaacaaatgtctccagatattgaacgagctgtttcattcatagaaaaagaaggagttacgaagttgttgtctgttaaggatgcaatggggatggtgaccaatcgttctttgttgattcttgtagaccattcaaagacagccttaacattatcaaaagaattttatgatttatttacccaaaccattgttattgaccaccatagaagggatcaggattttccagataatgcggttattacttatatcgaaagtggtgcaagtagtgccagtgagttggtaacggaattgattcagttccagaattctaagaaaaatcgtttgagtcgtatgcaagcaagtgtcttgatggctggtatgatgttggatactaaaaatttcacctcgcgagtaactagtcggacatttgatgttgctagctatctcagaacgcgcggaagtgatagtattgctatccaggaaatcgctgcgacagattttgaagaatatcgtgaggtcaatgaacttattttacaggggcgtaaattaggttcagatgtactaatagcagaggctaaggacatgaaatgctatgatacagttgttattagtaaggcagcagatgccatgttagccatgtcaggtattgaagcgagttttgttcttgcgaagaatacacaaggatttatctctatctcagctcgaagtcgtagtaaactgaatgtacaacggattatggaagagttaggcggtggaggccactttaatttggcagcagctcaaattaaagatgtaaccttgtcagaagcaggtgaaaaactgacagaaattgtattaaatgaaatgaaggaaaaggagaaagaagaatga

SEQ ID NO: 269 - DNA, 1416 bp, Streptococcus pneumoniae
atgaaagagaaaaatatgtggaaagaattgttgaatcgtgcaggctggattttggtctttttacttgccgtccttttatatcaggttcccctagtggttacctctattttgactttaaaagaagtagccctgctacagtcagggctgatagttgctggcctttcaattgtggttctggctctatttattatgggagctcgtaaaaccaagttagctagttttaatttttctttttttagagctaaagatttggcacgtttgggcttgagttatctagttattgtcgggtcaaatatacttggttccattttattgcaactgtcaaatgagacgacaacagctaaccagtctcagattaatgatatggttcaaaatagttcgttgatttccagtttcttcttgctagccttgcttgctccgatttgtgaggaaatcttgtgtcgtgggattgttcctaaaaagattttccgaggcaaggagaacttgggatttgtagtcggtacgattgtgtttgctttattgcatcaaccaagtaatttaccttctttattgatttatggaggtatgtcgacagttctatcttggacagcctacaagacccaacgtttggaaatgtcgatcttgcttcacatgattgttaatgggattgctttctgtttgttggctcttgtggtgattatgagtcggacattaggaatttctgtttaaatgaaagagaaaaatatgtggaaagaattgttgaatcgtgcaggctggattttggtctttttacttgccgtccttttatatcaggttcccctagtggttacctctattttgactttaaaagaagtagccctgctacagtcagggctgatagttgctggcctttcaattgtggttctggctctatttattatgggagctcgtaaaaccaagttagctagttttaatttttctttttttagagctaaagatttggcacgtttgggcttgagttatctagttattgtcgggtcaaatatacttggttccattttattgcaactgtcaaatgagacgacaacagctaaccagtctcagattaatgatatggttcaaaatagttcgttgatttccagtttcttcttgctagccttgcttgctccgatttgtgaggaaatcttgtgtcgtgggattgttcctaaaaagattttccgaggcaaggagaacttgggatttgtagtcggtacgattgtgtttgctttattgcatcaaccaagtaatttaccttctttattgatttatggaggtatgtcgacagttctatcttggacagcctacaagacccaacgtttggaaatgtcgatcttgcttcacatgattgttaatgggattgctttctgtttgttggctcttgtggtgattatgagtcggacattaggaatttctgtttaa

SEQ ID NO: 270 - DNA, 555 bp, Streptococcus pneumoniae
atggatacacaaaagattgaagcggctgtaaaaatgattatcgaggctgtaggagaggacgctaatcgcgagggcttgcaggaaacacctgctcgtgtagcccgtatgtatcaagagattttttcaggtcttggtcaaacagcagaggaacatttgtcaaaatcctttgaaattattgacgataatatggtggtagaaaaggatatctttttccataccatgtgtgaacaccacttcttgccattttatggtagagcgcacattgcctacattccagatggtcgtgtggcaggcttgtctaagctagcccgtacggttgaagtttattcgaaaaaaccacaaattcaagaacgtttgaatatcgaagtggccgatgccttgatggactatctaggtgctaaaggagcctttgttgtcattgaggcggaacatatgtgtatgagtatgcgtggtgttagaaaaccaggcactgcaaccttgacgacagtagctcgtggtctatttgaaacagataaggatctccgtgaccaagcttatcgtttaatggggctataa

SEQ ID NO: 271 - DNA, 1050 bp, Streptococcus pneumoniae
atgaaagacttgtttttaaagagaaagcaggcctttcgtaaggagtgtcttggttatctgcgctatgtgctcaatgaccactttgtcttgttcctgcttgtcctgttgggctttctagcctaccagtacagtcaactcttacaacattttcctgaaaatcattggcctatccttttgtttgtaggaattacgtctgttttacttttactttggggaggaactgccacctatatggaggctccagacaagctctttctcttagttggagaagaggaaattaagctccatctcaagcgtcaaactggcatttccctagtcttttggctctttgtacagacccttttcttgctgttatttgcgcctttatttttagcaatgggttatggcttgccagtttttctgctctatgtgcttttattgggggtaggaaaatatttccacttttgtcaaaaggccagcaaatttttcactgaaactggactggactgggactatgttatttctcaagaaagcaagcgtaagcaagtcttgcttcgtttctttgccctctttacgcaggtcaagggaatttcaaacagcgttaagcgtcgtgcctatctggactttattttaaaggctgttcagaaggtgcctgggaagatttggcaaaatctctatctgcgttcttatctgcgaaatggcgacctctttgctctcagtcttcgtcttctcttgctttccttgctggcgcaggtttttatcgagcaagcttggattgcgacagcagtggtagttctctttaactacctcttgctcttccagttgctggccctctatcatgcctttgactaccagtatttgacccaactctttccgctggacaaggggcaaaaggaaaaaggcttacaggaggtagttcgaggattgaccagttttgttttacttgtggaattagttgttgggttgattaccttccaagaaaaactagcccttctagccttactaggagctggtttggttttactagtcttgtatttgccttatcaggtaaaacgtcagatgcaggactaa

SEQ ID NO: 272 - DNA, 1197 bp, Streptococcus pneumoniae
atgagaaaatcaatagtattagcggcagataatgcctatcttattcctttagagacgactataaagtctgtattgtatcacaatagagatgttgatttttatattctcaacagtgatatagctcctgaatggtttaaattattggggagaaaaatggaagttgtgaattctacaattcgcagtgtacacattgataaagaactttttgaaagctataaaacaggacctcatataaattatgcttcttactttagattttttgcgacagaagtggttgaatctgatagggtattgtatctggattccgatatcattgtaactggggaactagctactttgtttgagatagatctcaaaggatattcaattggtgctgttgatgatgtctatgcctatgaaggacgaaaatctggatttaatactggtatgttactaatggatgttgcaaagtggaaagaacattctattgtcaatagtttattggaattagcggccgagcagaatcaagttgttcatcttggggatcagagtattttaaatatttattttgaggataattggctagccttagataaaacatataattatatggtgggtattgatatttatcaccttgctcaagaatgtgaacgtctagatgacaatccacctacaattgttcactatgctagtcatgataaaccttggaatacatatagtatatctagactacgtgaattatggtgggtttatagagatttggattggtcagagattgcttttcaacgttccgatttaaattattttgaaagaagcaatcagtctaaaaaacaagtgatgcttgtgacatggagtgcagatataaaacatttagagtatttagtacaacggttacctgattggcattttcatttggctgcaccgtgtgattgttctgaggagctgacctctctatcacagtatacgaatgtaacagtatatcaaaatgtattacatagtagaattgattggctattggacgattctatagtttatttagatattaatacaggtggagaggtttttaatgtagttacaagggcacaagaaagtggcaagaaaatcttcgcttttgatatcacacgtaaaagtatggatgatggactctatgacggtattttttctgtggagagaccagatgatttagtggatagaatgaagaatatagagatagagtaa

SEQ ID NO: 273 - DNA, 1218 bp, Streptococcus pneumoniae
atgactaagatttattcgtcaatagcagtaaaaaaaggactatttacctcatttctactgtttatctatgtattgggaagtcgtattattctcccttttgttgacctaaatactaaagattttttaggaggttcaacagcctatctagccttctcagccgccctaacaggtgggaatctaagaagtttatcaattttttctgttggattatccccttggatgtccgccatgattttatggcagatgttttctttttctaaacggttgggtttaacatctacgtctatagaaatacaagatcgccgtaaaatgtacctgaccttgctaattgctgtgattcaatccttggcagttagcttgagactgccagtacaatcctcctattctgcaatattggttgttctaatgaatacaatattgctgatagcaggaacattttttcttgtttggttgtcagatttaaatgcgagtatggggattggaggttctattgtaatcctcctatccagtatggttttaaatattcctcaggatgttttggaaacatttcagacagtacacattccaacagggattattgtgttacttgctttattaacccttgtcttttcttatttacttgcccttatgtatcgagctcgctatttggttcctgttaataaaattggcttacacaatcgatttaaacgctattcttatctcgaaatcatgttgaatcctgcaggtgggatgccttatatgtatgtgatgagttttcttagtgtaccagcttatttgttcatcttgttgggatttattttccctaatcattcagggttagcggctttatcaaaggaatttatggttggaaagcctttgtgggtctatgtttatatttcggtcttatttttatttagtatcatttttgcttttgttacgatgaatggagaagagattgcagaccgtatgaaaaaatctggagaatacatttatggtatttatccaggtgcggatactagtcgatttattaatcgattggtccttcgtttctcagtcataggtggtctctttaatgtgattatggcaggtggtcccatgctttttgttttgtttgatgaaaagttattacgattggcaatgattccaggcttatttatgatgttcgggggcatgatttttacgattagagacgaggtcaaggctttaaggctaaatgagacctatagacctttgatttag

SEQ ID NO: 274 - DNA, 2292 bp, Streptococcus pneumoniae
atgtcctctctttcggatcaagaattagtagctaaaacagtagagtttcgtcagcgtctttccgagggagaaagtctagacgatattttggttgaagcttttgctgtggtgcgtgaagcagataagcggattttagggatgtttccttatgatgttcaagtcatgggagctattgtcatgcactatggaaatgttgctgagatgaatacgggggaaggtaagaccttgacagctaccatgcctgtctatttgaacgctttttcaggagaaggagtgatggttgtgactcctaatgagtatttatcaaagcgtgatgccgaggaaatgggtcaagtttatcgttttctaggattgaccattggtgtaccatttacggaagatccaaagaaggagatgaaagctgaagaaaagaagcttatctatgcttcggatatcatctacacaaccaatagtaatttaggttttgattatctaaatgataacctagcctcgaatgaagaaggtaagtttttacgaccgtttaactatgtgattattgatgaaattgatgatatcttgcttgatagtgcacaaactcctctgattattgcgggttctcctcgtgttcagtctaattactatgcgatcattgatacacttgtaacaaccttggtcgaaggagaggattatatctttaaagaggagaaagaggaggtttggctcactactaagggggccaagtctgctgagaatttcctagggattgataatttatacaaggaagagcatgcgtcttttgctcgtcatttggtttatgcgattcgagctcataagctctttactaaagataaggactatatcattcgtggaaatgagatggtactggttgataagggaacagggcgtctaatggaaatgactaaacttcaaggaggtctccatcaggctattgaagccaaggaacatgtcaaattatctcctgagacgcgggctatggcctcgatcacctatcagagtctttttaagatgtttaataagatatctggtatgacagggacaggtaaggtcgcggaaaaagagtttattgaaacttacaatatgtctgtagtacgcattccaaccaatcgtccgagacaacggattgactatccagataatctatatatcactttacctgaaaaagtgtatgcatccttggagtacatcaagcaataccatgctaagggaaatcctttactcgtttttgtaggctcagttgaaatgtctcaactctattcgtctctcttgtttcgtgaagggattgcccataatgtcctaaatgctaataatgcggcgcgtgaggctcagattatctccgagtcaggtcagatgggggctgtgacagtggctacctctatggcaggacgtggtacggatatcaagcttggtaaaggagtcgcagagcttgggggcttgattgttattgggactgagcggatggaaagtcagcggatcgacctacaaattcgtggccgttctggtcgtcagggagatcctggtatgagtaaattttttgtatccttagaggatgatgttatcaagaaatttggtccatcttgggtgcataaaaagtacaaagactatcaggttcaagatatgactcaaccggaagtattgaaaggtcgtaaataccggaaactagtcgaaaaggctcagcatgccagtgatagtgctggacgttcagcacgtcgtcagactctggagtatgctgaaagtatgaatatacaacgggatatagtctataaagagagaaatcgtctaatagatggttctcgtgacttagaggatgttgttgtggatatcattgagagatatacagaagaggtagcggctgatcactatgctagtcgtgaattattgtttcactttattgtgaccaatattagttttcatgttaaagaggttccagattatatagatgtaactgacaaaactgcagttcgtagctttatgaagcaggtgattgataaagaactttctgaaaagaaagaattacttaatcaacatgacttatatgaacagtttttacgactttcactgcttaaagccattgatgacaactgggtagagcaggtagactatctacaacagctatccatggctatcggtggtcaatctgctagtcagaaaaatccaatcgtagagtactatcaagaagcctacgcgggctttgaagctatgaaagaacagattcatgcggatatggtgcgtaatctcctgatggggctggttgaggtcactccaaaaggtgaaatcgtgactcattttccataa

SEQ ID NO: 275 - DNA, 960 bp, Streptococcus pneumoniae
atgatagggactttcgccgctgctcttgtagctgtactagcaaatttcatcgtccctattgaaattaccccaaatagtgccaatactgaaattgcaccaccagatgggattgggcaggttctcagcaacctcttgctcaaactggttgacaacccagtcaacgccctgcttactgctaactatattagaatcttatcttgggcagtcatttttggaatcgctatgagagaagccagtaaaaatagtcaagaattgctaaaaactatcgctgacgtgacttctaaaattgtcgaatggatcatcaatctggctccatttggaatccttggtcttgtttttaaaaccatttctgacaagggagtcggaagccttgccaactacggtattttattggttctattagtaacgactatgctttttgttgcccctgtggtcaaccctttgattgccttcttctttatgagacgcaatccttaccctctagtttggaactgcctccgtgtcagcggtgtgacagcctttttcactcgtagttctgcgactaacattcctgtcaacatgaaactctgccatgaccttggactcaacccagatacctattctgtttctatcccactcggttctactatcaatatggctggagtagcgattaccattaaccttttgacccttgctgcagttaacactcttggaattcctgttgactttgccacagcctttgtcctcagtgtggtagcagctatctcatcctgtgatgcttcaggtattgccggaggttccctccttcttatcccagttgcttgtagccttttcggtatttctaacgatattgccatacaaattgttggggttggttttgtgattggtgtcatccaagactcatgtgaaacagcccttaactcttctacagatgtcctctttaccgccgttgccgaatacgcagcaacccgtaaaaaataa

SEQ ID NO: 276 - DNA, 954 bp, Streptococcus pneumoniae
atgtctattagccaacgtacgaccaagctcatcttagctacctgtcttgcctgcctgcttgcttattttctcaatctttcgtcagcagtttcggctggaattatcgctctcttgagcctatctgatacgcgtagaagtactttaaaactggctcgcaatcgtcttttttctatgcttctagctctggctatcggtgttctagcttttcacttgagcggatttcatatctggagtctcggcctctatctggccttctacgttcctttagcctacaagatgggctgggaaattggcatcacaccaagcactgttttggttagccatctcttggttcaagagtcaacctctccagaccttctagtcaatgaattccttctctttgctattggtacaggatttgccttgcttgttaatctctatatgccttcacgagaagaggaaatccagcactaccacacgctggtggaagaaaagttaaaagatatcctccagcgcttcaaatactatttatccagaggagacggacgcaaccgagcacagctggtagcagaattagacacgcttttgaaagaagccctcagactggtctatttggatcactctgaccacctctttcaccagacagactaccatatccactactttgagatgagacagcgacaaagtcgtatcctgagaaacatggcccaacagattaacacttgtcaccttgccgccagtgaaagcctgatcttagcgcaactcttttcaaaaattgcaggtcaactgagccagaccaatcctgcttctgatttgctagatgaaattgaacgttatctggaagtcttccggaaccgcagtctgcccaagacaagagaagaatttgaaacccgcgccacccttcttcaactcctacgtgaagccaaaaccttcatccaagtaaaagttgatttttaccaaaaatatagacagtaa

SEQ ID NO: 277 - DNA, 1614 bp, Streptococcus pneumoniae
atggaaatcatgtcgcttgcgattgctgtttttgccgtcatcattggtttagtcattggatatgtcagcatctcagctaagatgaaatcatctcaggaagctgcagagttgatgcttttaaatgctgaacaagaagcaactaatttacgtggacaagctgagcgtgaagcggatttacttgttaatgaagccaaacgtgaaagcaagtctcttaaaaaagaagcactattggaggccaaagaagaagccagaaaataccgtgaagaagtggacgctgaattcaaatcagaacgtcaagaactcaaacaaatcgaaagtcgtttgacagagagagctactagccttgaccgtaaggacgacaatttgacgagtaaagaacaaacacttgaacaaaaagaacaaagtatttctgatagagcgaaaaaccttgatgcgcgtgaagagcaattagaggaagtcgaaagacaaaaagaagcagaactagagcgtattggtgcgctgtctcaggcagaagcacgagatattatcttggctcagacagaggaaaacttgaccagggagattgccagtcgcattcgcgaagctgagcaagaggtcaaggaacgttctgacaaaatggccaaggacatcttggttcaagctatgcaacgtatcgctggtgaatatgtagcggagtcaacaaactcaacagttcatctgccagacgatactatgaagggacgcattattggtcgtgaaggtcgtaacattcgtacctttgaaagtttgacaggggtcgatgtgattatcgacgatacaccagaagtggtgaccttgtcaggatttgatccgattcgtcgtgagattgcccgtatgactatggaaatgttgctcaaagatggtcgtatacatccagctcgtatcgaagagttggttgagaaaaaccgtcaagagattgacaataagattcgtgaatacggtgaggctgctgcctatgaaattggtgcgccaaaccttcatccagacttgatgaagattatgggacgtttgcagttccgtacttcatatggacaaaatgttttgcgccattcgattgaggttgctaagttggctggtatcatggcgagcgaacttggtgaaaatgcggctcttgcccgtcgtgctggattccttcacgatatcgggaaagccattgaccatgaggttgaaggtagccacgttgaaatcggtatggaattggcccgtaagtacaaggaacccccagttgtggtgaatacgattgctagtcaccacggagatgttgaagctgagagcgtgatagcagttatcgtcgctgcagcagatgccttgagcgcagcccgtccaggtgctcgtagtgagtctcttgaaagctacatcaagcgtctccatgatttggaagaaattgctaacggctttgaaggagtgcaaactagctttgcccttcaagcaggacgtgaaattcgtatcatggtcaatccaggaaaaatcaaggacgacaaagtcacaatcttggctcacaaagttcgtaagaaaattgaaaacaatctcgattatccaggaaatatcaaggtaaccgtgattcgcgagcttcgtgcagtagattatgctaaataa

SEQ ID NO: 278 - DNA, 315 bp, Streptococcus pneumoniae
atgatgttaaaaccctctattgataccttgctcgacaaggttccttcaaaatattcactcgtaatcttggaagcaaaacgtgcccacgaattggaagcaggtgccccagcaactcaaggtttcaagtctgaaaaatcaactcttcgcgctttagaagaaatcgaatcaggaaacgttacaattcacccagatccagaaggaaaacgtgaagcagtgcgtcgccgtatcgaagaagaaaaacgccgcaaagaagaagaagaaaagaaaatcaaagagcaaattgctaaagaaaaagaagatggtgaaaaaatttaa

SEQ ID NO: 279 - DNA, 792 bp, Streptococcus pneumoniae
atgtcagcatatcaattaccgaccgtatggcaggatgaagctagtaatcaaggagcttttacggggctaaacagaccaacagcaggtgcccgtttcgaacaaaacttgccaaaaggagaacaagcttttcagctttattcactgggaacaccaaatggtgtgaaggttactatcttattggaagaattactagaagctggttttaaggaagcggcttacgacttgtataagattgctatcatggatggggatcaattcggatcagactttgtgaagctcaatccaaattccaagattccagccttattggaccagtcaggtactgaaaacgtaagagtctttgagtctgctcatattcttctttaccttgctgagaaatttggagcctttttaccaagtaatcctgtggaaaaggtagaagttttgaattggctattctggcaagcaggtgcagcaccttttctaggtgggggatttggacatttcttcaattatgctcctgaaaaattggaatatcctattaaccgttttacgatggaagtgaaacgccagttggatttattggataaggaattggctcagaaaccttatattgcaggcaatgactatacgattgcagatattgctatctggtcttggtatggacagttagttcaaggaaatctttaccaaggttctgcaaaattcttggatgcctcaagttatcaaaatctagtaaaatgggcagaaaaaattgccaatcgtccagctgttaagcgtggcttggaagtaacttatacagaaattaaatag

SEQ ID NO: 280 - DNA, 939 bp, Streptococcus pneumoniae
ttggcaagcttgatcacttctatcatcatgttctatgtcggtttcgatgttctaagagataccattcaaaagattctcagtcgggaagaaacggtcattgatcctcttggtgcaactctaggaatcatttctgcagcgattatgtttgtggtctatctctacaatactcgcctcagtaagaaatccaactccaatgcgctgaaggcagctgctaaggacaatctttctgacgctgttacctcacttggaaccgccattgccatcctagctagtagtttcaattatccgattgtggataaactggttgctatcatcatcactttctttatcttgaagactgcctatgatatcttcatcgagtcttcctttagtctttcagatggctttgacgaccgcctgctcgaggactaccaaaaggctatcatggaaattcccaaaatcagcaaggtcaaatcgcaaagaggtcgcacctacggtagcaacatctacctggatattacactagagatgaatcctgacttgtctgtttttgaaagccatgaaatcgcggatcaggtcgagtctatgctggaggagcgttttggcgtctttgataccgatgtccatatcgaaccagcacctatccctgaggatgaaattttagacaatgtctataaaaaattgcttatgcgtgaacaattgattgaccaaggaaaccaactagaagaactcttgactgatgattttgtctatattcgccaagatggagagcagatggataaagaggcttataagaccaaaaaagagttaaattctgctatcaaggacattcaaattacttccatcagtcaaaaaaccaaactcatctgctatgagttagatggtatcatccataccagtatctggcgtcgccacgaaacctggcaaaatatctttcatcaagaaaccaaaaaagaatag

SEQ ID NO: 281 - DNA, 795 bp, Streptococcus pneumoniae
atgacaattaaactagtagcaacggatatggacggaaccttcctagatgggaatggacgctttgatatggatcgtctcaagtctctcttggtttcctacaaggaaaaagggatttactttgcggtagcttcgggtcggggatttctgtctctagaaaaattatttgctggtgttcgtgatgacattattttcatcgcggaaaatggcagtttggtagagtatcaaggtcaggacttgtatgaagcgactatgtctcgtgacttttatctggcaacttttgaaaagctgaaaacttcaccttatgtagatatcaataaactgctcttgacgggtaagaagggttcatatgttctagatacggttgatgagacctatttgaaagtgagtcagcactataatgaaaatatccaaaaagtagcgagtttggaagatatcacagatgacattttcaaatttacaaccaacttcacagaagaaacgctggaagatggggaggcttgggtaaacgaaaacgttcctggtgttaaggccatgacaactggctttgaatccattgatattgttctggactatgtcgataagggagtggccattgttgaattagttaaaaaacttggtatcacaatggatcaggtcatggcttttggagacaatcttaatgacttacatatgatgcaggttgtgggacatcctgtagctcctgaaaatgcacgacctgaaattttagaattagcaaagactgtgattggtcaccataaggaacggtcggttatagcttatatggagggcttataa

SEQ ID NO: 282 - DNA, 819 bp, Streptococcus pneumoniae
atggcagatataaaattgattgcattggacttggacgggaccttgctgactactgataaaaggctgacggatcgtaccaaggaaaccttgcaagctgcgcgtgatcgtggtatcaaggtcgtattgacaactggtcgtcccttaaaagccatggatttctttctccatgagttagggactgacggtcaggaagatgagtataccattacttttaatggtggattagttcagaaaaatacaggagaaatccttgataaaacagtcttttcatatgatgatgtggcacgtttgtatgaagaaacagagaaattatcactgcctcttgatgccatctcagaaggaacagtttatcaaatccaatcggaccaagaaagtctttatgccaaattcaatccagctttgacctttgttccagtggactttgaagacttatctagtcaaatgacctacaacaaatgcgtgactgcctttgctcaagaacccttggatgcagccattcagaagatttctccagaattgtttgaccaatatgaaatctttaaatcacgtgaaatgttgctagaatggtcaccaaagaatgttcataaagcaacaggtttggcaaaactaatcagccatcttggaatcgaccaaagtcaagtgatggcttgtggtgacgaggccaatgacctctctatgattgaatgggcaggtcttggtgttgctatgcaaaacgctgttcctgaagtaaaggcagccgcaaatgtagtgacgccgatgaccaacgatgaggaagctgtcgcctgggctatcgaagaatatgtgctaaaggagaactaa

SEQ ID NO: 283 - DNA, 1257 bp, Streptococcus pneumoniae
atggaaagtttacttattctattattaattgccaatctagctggtctctttctgatttggcaaaggcaggataggcaggagaaacacttaagtaagagcttggaggatcaggcagatcatttgtcagaccagttggattaccgctttgaccaagccagacaagccagccagttagaccaaaaagatttggaagtggttgtcagcgaccgtttgcaagaagtgcggattgaattgcaccaaggtctgacccaagtccgtcaagaaatgacagataatctcctccaaactagagacaagacagaccaacgtctccaagccttgcaggaatcaaatgagcaacgtttggaacaaatgcgccagacggtcgaggaaaaactagaaaagaccttgcagacacgcttacaggcttcctttgagacagtttctaaacaactggagtctgtcaatcgtggccttggagaaatgcagacagttgcccgtgatgtcggagctcttaacaaggttctctctggaaccaagacgcgagggattctgggagaattgcaactggggcaaattattgaagacatcatgacacctgcccagtacgaacgagaatacgcaacggttgaaaactctagtgaacgagtggagtatgccatcaagttacccggacaaggcgaccaagaatacgtctatctgccaattgactctaagtttccactggcagattattaccgcttggaagaagcctatgagacaggtgacaaggatgagattgaacgctgtcgtaagtcactcctagcaagcgtcaagcgctttgctagggatattaggaacaagtacatagcaccacctcggacgaccaattttggagttttgtttgttccgacagaaggtctctactcagaaatcgtccgcaatccggtcttctttgatgatttgagacgggaagaacagattattgttgcaggaccaagtaccctatcagcccttcttaactccctatcagttggtttcaagacccttaatatccaaaagagtgccgaccatatcagcaagactcttgccagtgtcaagaccgagtttggcaagtttggtggtattctggtcaaggcacaaaaacatctccaacatgcctctggcaatattgatgaattattaaaccgtcgtaccatagctatcgagcggacgctccgtcacattgagttgtcagaaggtgagcctgcgcttgatctactccattttcaagaaaatgaggaagaatatgaagattag

SEQ ID NO: 284 - DNA, 942 bp, Streptococcus pneumoniae
atgaagattagtcacatgaaaaaagatgagttatttgaaggcttttacctaatcaaatcagctgacctgaggcaaactcgagctgggaaaaactacctagcctttaccttccaagatgatagtggcgagattgatgggaagctctgggatgcccaacctcataacattgaggcctttaccgcaggtaaggttgtccacatgaaaggacgccgagaagtttataacaatacccctcaagtcaatcaaattactctccgcctgcctcaagctggtgaacccaatgacccagctgatttcaaggtcaagtcaccagttgatgtcaaggaaattcgtgactacatgtcgcaaatgattttcaaaattgaaaatcctgtctggcaacggattgtccgaaatctctacaccaagtatgataaggaattctactcctatccagctgccaagaccaaccaccatgcctttgaaacgggcttggcctatcatacggcgaccatggtgcgtttggcagacgctattagcgaagtttatcctcagctcaataagagcctgctctatgcggggattatgttgcatgacttagctaaggtcatcgagttgacggggccagaccagacagagtacacagtgcgaggtaatcttcttggacatatcgctctcattgatagcgaaattaccaagacagttatggaactcggcatcgatgataccaaggaagaagtcgttttgcttcgtcatgtcatcctcagtcaccacggcttgcttgagtatggaagcccagtccgtccacgcattatggaagcagagattatccatatgattgacaatctggatgcaagcatgatgatgatgtcaacagctcttgctttggtggataaaggagagatgaccaataaaatcttcgctatggataatcgttccttctataaaccagatttagattaa

SEQ ID NO: 285 - DNA, 1512 bp, Streptococcus pneumoniae
atgagtgaaaaagctaaaaaagggtttaagatgccttcatcttacaccgtattattgataatcattgctattatggcagtgctaacttggtttatccctgcgggggcctttatagaaggtatttacgagactcagcctcaaaatccacaagggatttgggatgtcctcatggcaccgattcgggctatgctaggtactcatccagaggaaggttcgctcattaaagaaacgagcgcagcgattgatgtagccttcttcatccttatggttggtggtttccttggcattgtcaacaaaactggtgctcttgacgtagggattgcctctatcgtgaagaagtataagggccgcgaaaaaatgttaattttggtactgatgcctttgtttgccctcggtggtacaacttatggtatgggtgaagaaacaatggccttctatccactccttgtgccagttatgatggccgttggttttgatagcctgactggtgttgcaattattttgctcggttctcaaatcggctgtttggcatctactctgaatccatttgcgacaggtattgcttcagcgactgcgggagttggtacaggggacggtatcgtacttcgtctgatcttctgggttaccttgactgctcttagtacttggtttgtttaccgttatgcggataagattcaaaaagatccgactaagtcactggtttatagtactcgcaaagaagatttgaaacactttaacgtagaagaatcttcatctgtagaatctacacttagcagcaaacaaaaatcagttctcttcttatttgtgttgacattcatcttgatggtattgagcttcattccatggacagaccttggcgttaccatttttgatgactttaatacttggttgactggtcttccagttattggtaatattgtcggttcatctacttctgcactaggtacttggtacttcccagaaggcgcaatgctctttgcctttatgggtatcctgattggtgttatttatggtcttaaagaagataagattatctcttccttcatgaatggtgctgctgacttgctcagtgttgccttgatcgtagcgattgctcgtggtattcaagttatcatgaacgacggtatgattaccgatacaatcctcaactggggtaaagaaggcttgagcggtctatcttcacaagtctttatcgttgtaacttatatcttctatctacctatgtcattcttgatcccatcttcatctggtcttgccagcgcaactatgggtatcatggctccacttggagaatttgtaaatgtccgtcctagcttgattatcactgcttaccaatctgcttcaggtgtcttgaacttgattgcaccaacatctggtattgtgatgggagctcttgcacttggacgtatcaacattggtacttggtggaaattcatgggcaaactcgtagtcgctattattgtagtgaccatcgcccttcttctccttggaaccttccttccattcctataa

SEQ ID NO: 286 - DNA, 1332 bp, Streptococcus pneumoniae
atgaaaatagatataacaaatcaagttaaagatgaatttcttatatcattaaaaaccttgatttcctatccttcagtactcaatgaaggagaaaatggaacaccttttggacaagcaatccaagatgtcctagaaaaaactttagagatttgtcgagacataggtttcactacctatcttgaccctaaaggttattacggatatgcagaaatcggtcagggagcagagcttctggccattctctgtcatttggatgttgttccatcaggtgatgaagcagattggcagacaccgccatttgaagcaactatcaaagacggctgggtattcggacgtggtgtccaagatgataaaggcccttcgctcgcagctctctatgcagtaaaaagcttgctggaccaaggtattcagttcaaaaagcgcgtacgctttatctttggtaccgatgaggaaaccctctggcgctgcatggcacgctacaataccatcgaagaacaggccagtatgggctttgcacctgactcatcttttcctctgacctatgctgaaaaagggcttctacaggtcaaacttcatggccctggatcggatcaactagagcttgaagtaggaggcgcctttaacgttgtaccagacaaggccaactaccaaggtctcctctatgaacaggtttgtaacggtctcaaagaagctggttatgattaccaaaccactgaacaaaccgtaacggttctcggagtgccaaagcatgctaaggatgctagtcaaggtatcaatgctgtcatccgactagctaccattcttgctcctctccaagaacaccctgctctcagttttcttgcaacacaagcaggtcaagacggcacaggaagacaaatctttggtgatatagcagatgaaccttctggtcacctatcctttaatgtcgcaggtctcatgatcaatcatgaacgttctgaaatccgtattgacattcggactcctgtcttagctgacaaggaagaactagtagagttgcttacaagatgtgcacaaaactaccaactccgctacgaagagtttgactatctagcgcctctatacgtcgcagaagacagtaaactcgttagcacactgatgcaaatctaccaagaaaagactggcgataacagtcctgctatttcatccggtggtgccacttttgctcgcaccatgccaaattgtgtagccttcggcgccttattcccaggagcgaagcagacagaacatcaggcaaatgaatgtgccgttctagaagatttgtaccgtgctatggatatttatgccgaagccgtctatcgacttgcaacttaa

SEQ ID NO: 287 - DNA, 2349 bp, Streptococcus pneumoniae
atgtctaattcatttgtcaagttgttagtctctcaattatttgcaaatttagcagatattttctttagagtaacaatcattgctaacatatacattatttcaaaatcagtaattgccacatcactagttcctatcttaataggaatatcctcttttgttgcgagtcttttagttccgttggttactaaaaggttagcgctaaatagggttttatctttatctcaatttggaaagactatattattggcgatactggtaggaatgtttaccgtaatgcaatccgtagcgcctttggtgacctatctatttgttgttgcaatttccatactagatggttttgcagcacccgtttcctatgctattgtgccacgctatgcgaccgatttgggtaaggctaattcagccttatcaatgactggtgaagctgttcaattgataggttggggattaggtggactcttgtttgcaacaattggtctgttacctaccacgtgtatcaatttagtcttgtatatcatttctagctttctgatgttatttcttcctaacgctgaagtggaggtgttagagtcagaaactaatcttgaaattttgctcaaaggttggaagttagttgctagaaatcctagattaagactttttgtatcagcaaatttattggaaattttttcaaatacgatttgggtttcttccattatacttgtttttgtaacggagttattaaataaaacggaaagttactggggatattctaatacagcatactctattggtattataattagtggcttaattgcttttaggctatctgaaaagttccttgctgctaaatgggaaccccaattattcaccccaaatctaaaaaccatccagaatccttgccttagcttagatcctggatggtttcttttttcacccaatgggtgttttttactagacaaaaaagagtttcccctttatggtataagtgtagaaaaaaacacaaaaagaaaggaaactcacatgaacagtttaccaaatcatcacttccaaaacaagtctttttaccaactatctttcgatggaggtcatttaacccagtatggtggtcttatcttttttcaggaacttttttcccagttgaaactaaaagagcggatttctaagtatttagtaacgaatgaccaacgccgctactgtcgttattcggattcagatatccttgtccagttcctctttcaactgttaacaggttatggaacggactatgcttgtaaagaattgtcagctgatgcctactttccaaaattgttggaaggagggcagcttgcttcacagccaaccttatcccgttttctttccagaactgacgaggaaacagtccatagtttgcgatgcctcaaccttgaattggtcgaattctttttacagtttcaccagctaaaccaactcattgtagatatcgattctacccatttcacaacttatggcaagcaagaaggtgttgcttataacgcccactatcgtgctcatggctatcatcctctttatgctttcgaggggaagacaggttattgtttcaatgcccagcttcgtcctggtaatcgttattgttctgaagaggcagacagctttatcacacctgttttagaacggtttaatcaacttctctttcgaatggatagtggctttgcgaccccaaaattatacgatttaattgaaaaaacagggcaatactacctcataaaactcaagaaaaatactgttctgagccgtcttggagacctttccctcccttgcccacaggatgaggacttaaccatcttgccccactccgcctactcagaaactctctatcaagcaggatcttggtcgcacaagcgtcgtgtctgccagttctctgaacgaaaagaaggaaacttgttctacgatgttatttctctcgttacaaatatgacgagtggaacaagccaagaccagtttcagctttatcgtggacgtggtcaagccgagaatttcatcaaggagatgaaggagggattttttggcgataaaacggatagttcaaccttaatcaaaaacgaagttcgtatgatgatgagctgtatcgcctacaatctctatctttttctcaaacatctagctggaggtgacttccaaactttaacaatcaaacgcttccgccatctttttcttcacgtggtgggaaaatgtgttcgaacaggacgcaagcagctcctcaaattgtctagtctctatgcctattccgaattgttttcagcactttattctaggattagaaaagtcaacctgaatcttcctgttccttatgaaccacctagaagaaaagcgtcgttaatgatgcattaa

SEQ ID NO: 288 - DNA, 1245 bp, Streptococcus pneumoniae
atgatggagttttttcaacagcttcctcatttagagccatatggcaatcctcagtattttgtttatgtgattgctgcaaccttgcccatctttataggtctctttttcaagaaacgctttgcctggtatgaagtgttggtaagtctcttctttattgtcaccatgttggtgggtggaaagaccaatcaactagctgccttgggtatttacctttgctgggaaatattgctcctgcttttctacaagcattatcgaaaaagcaaggatggcaagtgggtcttctacttagttagttttctgtccctacttccgattatctttgtcaaggtgcaaccagctatcaatggaacgcagtctttgcttgggttcttgggaatttcttacctgacctttcgttcggttggaattgtcatcgagctgagagatggagtgattaaggattttaccctctgggaattcctccgtttccttctcttcatgccaactttctcgagtggtccaatcgatcgctttaagcgatttaatgaaaattatcaggctattcctgagcgagatgagttgatggatatgctggatgaatctgtccgctatatcatgtggggctttttgtataagtttatcctagctcatgttttaggagagaccttactacctcctctgaagaatttagccttgcagtcaggtggcttctttaatctctatgccttggcagttatgtatacttttggtctggaactcttctttgactttgcaggttattctatgtttgctttggccatctcaaacttgatgggaatccgtagccctatcaactttaacaagccctttttatcaagggatttaaaggagttttggaatcgctggcatatgagtctgtccttctggttccgtgactttgtctttatgcgaatggtgatggtgttaaccagaaagaaagtctttaaaaatcgtaatgtaacctcaagcatggcctacattgtaaatatgctgattatgggattttggcatggtgtgacctggtactatatcgcctatggactctttcatggactaggcttggtcatcaatgatgcctgggttcgcaagaaaaaaacgctcaataaggaacggaaaaaagcagggaaggctgccctacctgagaatcgctggattcagttgcttggcatggttgtcactttccatgttgtcatgttgtcattcttaatcttttctggattcttgaataatctatggtttaaaaaataa

SEQ ID NO: 289 - DNA, 1269 bp, Streptococcus pneumoniae
atgcttaaacgcttatggatgatcttcggaccggtcttgatcgctggtttgttggtttttctgctcattttcttttatcctactgagatgcatcataatctaggagctgaaaagcgttcagcagtggctactactatcgatagttttaaggagcgaagtcaaaaagtcagagcactatctgatccaaatgtgcgttttgttcccttctttggctctagtgaatggcttcgttttgacggtgctcatcctgcggtattagctgagaaatacaatcgttcctaccgtccttatcttttaggacaggggggagctgcatcgcttaaccaatattttggaatgcaacagatgttaccacagctggagaataaacaagttgtgtatgttatctcacctcagtggttcagtaaaaatggctatgatccagcagccttccagcagtattttaatggagaccagttgactagttttctgaaacatcaatctggggatcaggctagtcaatatgcagcgactcgcttactgcaacagttcccaaacgtagctatgaaggacctggttcagaagttggcaagtaaagaagaattgtcgacagcagacaatgaaatgattgaattattggctcgttttaatgaacgccaagcttccttttttggtcagttttcggttagaggctatgttaactacgataagcatgtagctaagtatttaaaaatcttgccagaccagttttcttatcaggcaatagaagatgttgtcaaagcagatgctgaaaaaaatacttccaataatgagatgggaatggaaaattatttctataatgagcagatcaagaaggatttgaagaaattaaaggattctcagaaaagctttacctatctcaagtcgccagagtataatgacttgcagttggttttaacacagttttctaaatctaaggtaaacccgatttttatcattccacctgttaataaaaaatggatgaactatgctggtctacgagaggatatgtaccaacaaacggtgcagaagattcgctaccagttagaaagtcaaggttttaccaatatagcagatttttctaaggacggcggggagcctttctttatgaaggacaccattcaccttggttggttgggttggttggcttttgacaaggcagttgatcctttcctatccaatcccacaccagctccgacttaccatctgaatgagcgctttttcagcaaagattgggcgacttatgatggagatgtcaaagaatttcaatag

SEQ ID NO: 290 - DNA, 621 bp, Streptococcus pneumoniae
atggagaaaaacctcaaggctttgaaacaaacaacagaccaagaaggcccagcaattgaacctgaaaaggcagaggataccaagacagtccaaaatggttacttcgaggatgcagctgtcaaggaccgcaccttgagtgactatgcaggtaactggcaatcagtttatcctttccttgaagacggcacgtttgaccaagtctttgactacaaggctaagttgactggtaagatgacccaggctgagtacaaggcttactatacaaaaggctatcatacagatgtgactaagattaacattactgataatactatggaatttgttcaaggtggacaaagcaagaaatacacttacaagtatgtcggtaagaaaattttgacttacaagaaaggcaatcgtggcgtgcgtttcctctttgaagccacagatgctgacgctggacaattcaagtatgttcagtttagtgaccacaatgttgccccagttaaggcagaacatttccatatcttctttggaggcacaagccaagaagccctctttgaagaaatggacaactggccaacctactacccagataacctatctggccaagaaatcgcccaagaaatgttggcgcattga

SEQ ID NO: 291 - DNA, 444 bp, Streptococcus pneumoniae
atgaaagatggtcatttgctagcccatcatattcgtttgttgaatgggcggatttttcaaaagttactgagtcaagatcctgaggctctttataggggtgaacagggcaagattttagcggttttatggaatagtgaaactggctgcgcaactgcgacagatatcgcgcttgcgactggacttgcgaataatacgctgacgactatgataaaaaagctagaggaacaaaagcttgtaattgttagtccgtgtggaaaagacaagcgtaagaagtatttagttttaacggagttaggcaagtcccagaaagaagtggggcatcgtgtcagtcagaaattggatactatcttttacaaaggattttcagaggaagaaattcaccaatttgaaggttttcaagaaagaattttggcgaatctgaaagagaagggaaatgaggtttag

SEQ ID NO: 292 - DNA, 1521 bp, Streptococcus pneumoniae
atgactaatttaattgcaacttttcaggatcgttttagtgattggttgacagctctatctcaacatttgcagttgtcgcttttgaccttgttactagctattttgcttgcgattcccttggctgtttttcttcgctatcatgagaagctggccgactgggtcttgcagattgcaggtattttccagaccatcccgtctctggccttgttggggctctttatccctttgatgggaattgggaccttgccggctttgacagctctagtgatttatgcgattttccctattttgcaaaatactatcactgggctgaagggaattgatccgaacctgcaagaggctgggattgcctttgggatgaccagatgggaacgtctcaagaaatttgaaattccactcgccatgcctgttatcatgtctgggattcggacggcagctgttttgattatcggtacggcaaccttggcggccttgattggtgcagggggactaggttcctttattcttttgggaattgaccgtaataatgccagtttgattttgattggggcactttcttctgcagtgctagccattgcctttaacttcctactaaaagtgatggaaaaagcaaaattacggacgattttctcaggttttgccttggtggctttattactgggtctgtcttatagtccagctcttttggttcaaaaagagaaggaaaacttggttattgctgggaaaataggtccagaaccagaaattttggccaatatgtataagttgctgattgaagaaaataccagcatgactgcgactgttaaaccgaattttgggaagacaagcttcctttatgaagctctgaaaaaaggcgatattgacatctatcctgaatttactggtacggtgactgaaagtttgcttcaaccatcacccaaggtgagtcatgaaccagaacaggtttatcaggtggcgcgtgatggcattgctaagcaggatcatctagcctatctcaaacccatgtcttatcaaaacacctatgctgtagctgttccgaaaaagattgctcaagaatatggcttgaagaccatttcagacttgaaaaaagtggaagggcagttgaaggcaggttttacactcgagtttaacgaccgtgaagatggaaataagggcttgcaatcaatgtatggtctcaatctcaatgtagcgaccattgagccagcccttcgctatcaggctattcagtcaggggatattcaaatcacggatgcctattcgactgatgcggaattggagcgttatgatttacaggtcttggaagatgacaagcaactcttcccaccttatcaaggggctccactcatgaaagaagctcttctcaagaaacacccagagttggaaagagttcttaatacattggctggtaagattacagaaagccagatgagccagctcaactaccaagtcggtgttgaaggcaagtcagcaaagcaagtagccaaggagtttctccaagaacaaggtttgttgaagaaatga

SEQ ID NO: 293 - DNA, 810 bp, Streptococcus pneumoniae
atgatgcatacttatttgcaaaagaaaattgaaaatatcaaaacaaccctaggtgaaatgtcaggtggttaccgtcgtatggttgcggctatggctgatttaggattttcaggaactatgaaggctatctgggatgacctctttgcccatcgtagttttgcccagtggatttatttgctggttttaggaagttttcctctctggctggagttggtttacgaacatcgtattgttgactggattgggatgatttgtagcttgacagggattatctgtgtaatctttgtatcggaaggtcgagcaagtaattatctttttggcttgattaactctgttatttaccttattttggccctacagaaaggcttttatggtgaggtgctgacgacactttacttcacagtcatgcagccaattggacttctagtttggatttatcaggcacagtttaagaaggaaaagcaggagtttgtcgcgcgtaaactggacggcaagggctggacaaagtatctttccattagtgtgctttggtggttggcctttggcttcatttatcagtctattggtgccaatcgtccctatcgtgattcaatcacagatgcaaccaatggggtagggcaaatcctcatgacagctgtttaccgtgaacagtggatattctgggcggctaccaatgtcttttcaatctatctctggtggggagaaagcctgcaaattcaagggaaatatctaatttatctcattaacagtctagttggttggtatcaatggagcaaggcagctaagcagaatactgatttacttaactag

SEQ ID NO: 294 - DNA, 900 bp, Streptococcus pneumoniae
atgagaaatatgaaggcaaaatatgctgtttgggtggcttttttcttaaatttgacttatgccattgttgagtttattgcaggtggagtatttggttctagcgctgttcttgctgactctgtgcatgacttgggagatgcgattgcaattggaatatcagcttttctagaaacaatctccaatcgtgaagaagacaatcagtacaccttgggctataagcggtttagcctgctaggagccttggtaacagctgtgattctcgtaacgggctctgttctagtcattttggaaaatgtcacgaagattttgcatccgcaaccagtcaatgatgaggggattctctggttaggaattattgcgattactatcaatctgttagcgagtctggtggttggtaagggaaagacaaagaatgagtctattctgagtctgcattttctggaagatacgctagggtgggtagctgttatcctgatggcgattgttcttcgatttacggactggtatatcctagatcctcttttgtcccttgtcatttctttctttattctttcaaaagcccttccacgtttttggtctacactcaagattttcttggatgctgtgccagaaggtcttgatatcaagcaagtaaagagtggcctggagcgattggacaatgtggccagccttaatcagcttaatctctggactatggatgctttggaaaaaaatgccattgtccatgtttgtctaaaagaaatggaacatatggaaacttgtaaagagtctattcgaattttcctaaaagattgtggttttcaaaatattaccattgaaattgatgctgacctagaaactcaccaaacccataagcgaaaggtgtgtgacttggaacggagttatgagcatcaacattag

SEQ ID NO: 295 - DNA, 729 bp, Streptococcus pneumoniae
atgattgaatacaaaaatgtagcactgcgctacacagaaaaggatgtcttgagagatgtcaacttacagattgaggatggggaatttatggttttagtagggccttctgggtcaggtaagacgaccatgctcaagatgattaaccgtcttttggaaccaactgatggaaatatttatatggatgggaagcgcatcaaagactatgatgagcgtgaacttcgtctttctactggttatgttttacaggctattgctctttttccaaatctaacagttgcggaaaatattgctctcattcctgaaatgaaggggtggagcaaggaagaaattacgaagaaaacagaagagcttttggctaaggttggtttaccagtagccgagtatgggcatcgcttacctagtgaattatctggtggagaacagcaacgggtcggtattgtccgagctatgattggtcagcccaagattttcctcatggatgaacccttttcggccttggatgctatttcgagaaaacagttgcaggttctgacaaaagaattgcataaagagtttgggatgacaacgatttttgtaacccatgatacggatgaagccttgaagttggcggaccgtattgctgtcttgcaggatggagaaattcgccaggtagcgaatcccgagacaattttaaaagcgcctgcaacagactttgtagcagacttgtttggaggtagtgttcatgactaa

SEQ ID NO: 296 - DNA, 1083 bp, Streptococcus pneumoniae
atgtcagcagttgctatttcagctatgaccaaggttatgcaagaaacccacggaaatccttctagtattcatggtcatggtcgtcaagctggcaaactcttgcgagaagcccgtcaggaactagcccagttactaaggacaaaacctcaacatatctttttcacttctggtgggactgaaggcaataatactaccatcattggctactgtcttcgtcaccaagaacaaggaaaacatatcatcacaactgccatcgagcaccatgctgtccttgaaacaattgattacttggttcaacactttgggtttgaagcaaccattatccagccagaaaatcaagaaatcacagcccagcaaattcaaaaggctttacgtgacgatacgattttggtttctaccatgtttgtcaataatgagacaggaaacctactgcccatcgctgaaattggccaaatactcaagcaacaccctgctgcctatcatgttgatgcagttcaggctattggtaaaatcccaattcattcagaagaattgggcattgattttctcactgcttctgcccacaaattccatggtcctaagggaatcggttttctctacgcatctagcatggactttgattcctatctacatggcggagaccaggaacagaaaaaacgtgcaggaactgaaaatctgcctgccattgtaggcatggttgcagccctaaaagaagacctagaaaaacaagaagaacattttcaacatgtacaaaatctagaaactgcctttctggcagagctggagggcattcagtattacctgaatagaggaaaacatcatctcccttatgttctcaatattggatttcctggtcagaaaaatgacctcttactccttcggctagatttagctggaatttcaatctctactggctcagcctgtactgcaggcgttgtccaatccagccatgttcttgaagccatgtatggcgcaaattcagaacgcttgaaggaatcccttcgcatcagtttgtcgccacaaaataccgttgaagacctacaaaccctcgcaaaaaccttaaaagaaattatcggaggttag

SEQ ID NO: 297 - DNA, 1380 bp, Streptococcus pneumoniae
atgttattcaaattatctaaggaaaaaatagagctaggcttatctcgtttatcgccagcccgtcgtatttttttgagttttgccttggtcattttactaggctctcttcttttgagcttgccctttgtccaagttgaaagctcacgagcgacttattttgatcatcttttcactgctgtctctgcagtctgtgtgacgggtctctcaacccttccagtagctcacacctataatatctggggtcaaataatctgtttgctcttgattcagatcggtggtctagggctcatgacctttattggggttttctatatccagagcaagcaaaagcttagtcttcgtagccgtgcaactattcaggatagttttagttatggagaaactcgatctttgagaaagtttgtctattctatttttctcacgacctttttggttgagagcttgggagctattttgcttagttttcgccttattcctcaacttggctggggacgtggtctttttagttccatttttctagcgatctcagccttctgtaatgccggttttgataatttagggagcaccagtttatttgcttttcagaccgatttactggtcaatctggtgattgcaggcttgattattacaggcggccttggttttatggtctggtttgatttggctggtcatgtaggaagaaagaaaaaaggacgtctgcactttcatacgaagcttgtactattattgactataggtttgttgttatttggaacagcaactactctctttcttgagtggaacaatgctggaacgattggcaatctccctgttgccgataaggttttagttagcttttttcaaacagtgacgatgcgaacagctggcttttctacgatagattatactcaggctcatcctgtgactcttttgatttatatcttacagatgtttctaggtggggcacctggaggaacagctgggggactcaagattacgacattttttgtcctcttggtctttgcacgaagtgagcttctaggcttgcctcatgccaatgttgcgagacgaacgatcgcgccgcgaacggttcaaaaatcctttagtgtctttattatctttttgatgagcttcttgataggattgattctgctagggataacagccaaaggcaatcctccctttatccacctcgtatttgaaaccatttcagctcttagtacagttggtgtaacggcaaatctgactcctgaccttgggaaattggctctcagtgttatcatgccacttatgtttatgggacgaattggtcccttgaccttgtttgttagcttggcagattaccatccagaaaagaaagatatgattcactatatgaaagcagatattagtattggttaa

SEQ ID NO: 298 - DNA, 666 bp, Streptococcus pneumoniae
atgtcagatcgtacgattggaattttgggcttgggaatttttgggagcagtgtcctagctgccctagccaagcaggatatgaatattatcgctattgatgaccacgcagagcgcatcaatcagtttgagccagttttggcgcgtggagtgattggtgacatcacagatgaagaattattgagatcagcagggattgatacctgcgataccgttgtagtcgcgacaggtgaaaatctggagtcgagtgtgcttgcggttatgcactgtaagagtttgggggtaccgactgttattgctaaggtcaaaagtcagaccgctaagaaagtgctagaaaagattggagctgactcggttatctcgccagagtatgaaatggggcagtctctagcacagaccattcttttccataatagtgttgatgtctttcagttggataaaaatgtgtctatcgtggagatgaaaattcctcagtcttgggcaggtcaaagtctgagtaaattagacctccgtggcaaatacaatctgaatattttgggtttccgagagcaggaaaattccccattggatgttgaatttggaccagatgacctcttgaaagcagatacctatattttggcagtcatcaacaaccagtatttggataccctagtagcattgaattcgtaa

SEQ ID NO: 299 - DNA, 540 bp, Streptococcus pneumoniae
atgaagttattgtctatcgcaatttctagctataatgcagcagcctatcttcattactgtgtggagtcgctagtgattggtggtgagcaagttgggattttgattatcaatgacgggtctcaggatcagactcaggaaatcgctgagtgtttagctagcaagtatcctaatatcgttagagccatctatcaggaaaataaatgccatggcggtgcggtcaatcgtggcttggtagaggcttctgggcgctattttaaagtagttgacagtgatgactgggtggatcctcgtgcctacttgaaaattcttgaaaccttgcaggaacttgagagcaaaggtcaagaggtggatgtctttgtgaccaattttgtctatgaaaaggaagggcagtctcgtaagaagagtatgagttacgattcagtcttgcctgttcggcagatttttggctgggaccaggtcggaaatttctccaaaggccagtataccatgatgcactcgctgatttatcggacagatttgttgcgtgctagccagttctaa

SEQ ID NO: 300 - DNA, 1872 bp, Streptococcus pneumoniae
atgaaattcaatccaaatcaaagatatactcgttggtctattcgccgtctcagtgtcggtgttgcctcagttgttgtggctagtggcttctttgtcctagttggtcagccaagttctgtacgtgccgatgggctcaatccaaccccaggtcaagtcttacctgaagagacatcgggaacgaaagagggtgacttatcagaaaaaccaggagacaccgttctcactcaagcgaaacctgagggcgttactggaaatacgaattcacttccgacacctacagaaagaactgaagtgagcgaggaaacaagcccttctagtctggatacactttttgaaaaagatgaagaagctcaaaaaaatccagagctaacagatgtcttaaaagaaactgtagatacagctgatgtggatgggacacaagcaagtccagcagaaactactcctgaacaagtaaaaggtggagtgaaagaaaatacaaaagacagcatcgatgttcctgctgcttatcttgaaaaagctgaagggaaaggtcctttcactgccggtgtaaaccaagtaattccttatgaactattcgctggtgatggtatgttaactcgtctattactaaaagcttcggataatgctccttggtctgacaatggtactgctaaaaatcctgctttacctcctcttgaaggattaacaaaagggaaatacttctatgaagtagacttaaatggcaatactgttggtaaacaaggtcaagctttaattgatcaacttcgcgctaatggtactcaaacttataaagctactgttaaagtttacggaaataaagacggtaaagctgacttgactaatctagttgctactaaaaatgtagacatcaacatcaatggattagttgctaaagaaacagttcaaaaagccgttgcagacaacgttaaagacagtatcgatgttccagcagcctacctagaaaaagccaagggtgaaggtccattcacagcaggtgtcaaccatgtgattccatacgaactcttcgcaggtgatggcatgttgactcgtctcttgctcaaggcatctgacaaggcaccatggtcagataacggcgacgctaaaaacccagccctatctccactaggcgaaaacgtgaagaccaaaggtcaatacttctatcaagtagccttggacggaaatgtagctggcaaagaaaaacaagcgctcattgaccagttccgagcaaatggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaaagacagtatcgatgttccagcagcctacctagaaaaagccaagggtgaaggtccattcacagcaggtgtcaaccatgtgattccatacgaactcttcgcaggtgatggtatgttgactcgtctcttgctcaaggcatctgacaaggcaccatggtcagataacggtgacgctaaaaacccagccctatctccactaggtgaaaacgtgaagaccaaaggtcaatacttctatcaattagccttggacggaaatgtagctggcaaagaaaaacaagcgctcattgaccagttccgagcaaacggtactcaaacttacagcgctacagtcaatgtctatggtaacaaagacggtaaaccagacttggacaacatcgtagcaactaaaaaagtcactattaacataaacggtttaatttctaaagaaacagttcaaaaagccgttgcagacaacgttaagacagtatcgatgttccagcagcctacctag

SEQ ID NO: 301 - DNA, 1053 bp, Streptococcus pneumoniae
atgaaactaaaaagttatattttggttggatatattatttcaaccctcttaaccattttggttgttttttgggctgttcaaaaaatgctgattgcgaaaggcgagatttactttttgcttgggatgaccatcgttgccagccttgtcggtgctgggattagtctctttctcctattgccagtctttacgtcgttgggcaaactcaaggagcatgccaagcgggtagcggccaaggattttccttcaaatttggaggttcaaggtcctgtagaatttcagcaattagggcaaacttttaatgagatgtcccatgatttgcaggtaagctttgattccttggaagaaagcgaacgagaaaagggcttgatgattgcccagttgtcgcatgatattaagactcctatcacttcgatccaagcgacggtagaagggattttggatgggattatcaaggagtcggagcaagctcattatctagcaaccattggacgccagacggagaggctcaataaactggttgaggagttgaattttttgaccctaaacacagctagaaatcaggtggaaactaccagtaaagacagtatttttctggacaagctcttaattgagtgcatgagtgaatttcagtttttgattgagcaggagagaagagatgtccacttgcaggtaatcccagagtctgcccggattgagggagattatgctaagctttctcgtatcttggtgaatctggtcgataacgcttttaaatattctgctccaggaaccaagctggaagtggtggctaagctggagaaggaccagctttcaatcagtgtgaccgatgaagggcagggtattgccccagaggatttggaaaatattttcaaacgcctttatcgtgtcgaaacttcgcgtaacatgaagacaggtggtcatggattaggacttgcgattgcgcgtgaattggcccatcaattgggtggggaaatcacagtcagcagccagtacggtctaggaagtacctttaccctcgttctcaacctctctggtagtgaaaataaagcctaa

SEQ ID NO: 302 - DNA, 528 bp, Streptococcus pneumoniae
atgtttggtcaaacggctcaacatggtcttacgaatagcctgaaagacttctggatttttctgctgaatataggtccacaattggcgtttttttgccagatgctccgctgttccagatcggttgagcagggtactggaaatcaccgtcgtgagttcaatatgattcagcagatattctcgcattttgggatgactcacttgggacaaatcaagttggtctatcaagagtcgattgaccttgagttgctggtcaatgcacttaatcatcacttgctcattgacagactggtcctcacgcccaatcaaataacgatagaaatcgacaggcagatagtacatggtcttgacctgctgaaggggcgtaaagacaaagagattatcgacataaaaagtatgttcaggcagttagaactggctagcacgcaacaaatctgtccgataaatcagcgagtgcatcatggtatactggcctttggagaaatttccgacctggtcccagccaaaaatctgccgaacaggcaagactga

SEQ ID NO: 303 - DNA, 477 bp, Streptococcus pneumoniae
atggaacatttagcaacttatttttcaacctatggaggagctttcttcgctgcattgggaattgtattggcggttggattaagcggtatggggtctgcttatggagttggtaaggctgggcaatctgccgcagctttactgaaagaacagcctgaaaagtttgcctcagctttgatattgcaattattgcccggaacacaaggattatatggttttgttattggaattttaatttggttgcaattaactccagaacttcctttagaaaaaggcgttgcttatttctttgtagctcttccaattgctattgtaggatacttttcagctaagcatcaaggaaatgtagcagtagcgggaatgcaaatcttggctaaaagaccaaaagaattcatgaagggagcaattttagctgccatggtagaaacctatgcaattcttgcttttgtcgtatcattcattttgacccttcgtgtataa

SEQ ID NO: 304 - DNA, 498 bp, Streptococcus pneumoniae
atgttaaaatcagaaaaacaatcacgttatcaaatgttaaatgaagaattgtccttcctattggaaggcgaaaccaatgttttggctaatctttccaacgccagtgctctcataaaatcacgttttcctaataccgtatttgcaggcttttatttgttcgatggaaaggaattggttttaggccccttccaaggaggtgtttcctgcatccgtattgcactaggcaagggtgtttgtggtgaggcagctcactttcaggaaactgttattgttggagatgtgacgacctatctcaactatatttcttgtgatagtctagctaaaagtgaaattgtggtgccgatgatgaagaatggtcagttacttggagttctggatctggattcttcagagattgaggattacgatgctatggatcgagattatttggaacaatttgtcgctattttgcttgaaaagacagcatgggactttacgatgtttgaggaaaaatcttaa

SEQ ID NO: 305 - DNA, 771 bp, Streptococcus pneumoniae
atgtcagtattagagatcaaagatcttcacgttgagattgaaggaaaagaaattttaaaaggggttaacctgaccctgaaaacaggagaaattgccgctatcatgggaccaaatggtacaggtaaatcgactctttctgccgctatcatgggaaatccaaactatgaagtaactaaaggtgaagttttgtttgatggcgtaaacatccttgagttggaagtggatgagcgtgcgcgtatgggacttttccttgctatgcaatacccatcagaaatccctggaattaccaatgctgagtttcttcgtgccgctatgaatgcgggtaaagaagatgatgagaagatttcagttcgtgagtttattactaagctagatgaaaaaatggaattgctcaacatgaaagaagaaatggcagagcgttacctcaacgaaggcttctctggtggtgagaaaaaacgcaatgaaattcttcaacttttgatgttggagccaacatttgctcttttggacgagattgactcaggtcttgatattgacgctcttaaagttgtgtctaaaggtgtcaatgccatgcgtggtgaaggttttggtgctatgatcatcactcactaccaacgtcttttgaactatatcacacctgatgtggtacacgtgatgatggaaggtcgtgttgtcctttctggtggtccagaattggctgcgcgtttggaacgtgaaggatacgcaaaattagctgaagaacttggctacgactacaaggaagaattgtaa

SEQ ID NO: 306 - DNA, 471 bp, Streptococcus pneumoniae
atgccctacaaaagacaaaggagtttttcaatggcactttctaaactagatagcctttatatggcagtggtagcagaccattcgaaaaatccacatcaccaagggaagttagaagatgctgagcaaatcagtctcaacaatccgacttgtggggatgtcatcaacctctctgtcaagtttgatgcagaggaccgtttggaagatattgcttttctaaattcaggatgcacgatttcaactgcttctgctagtatgatgacagatgccgttttaggaaaaaccaaacaagaaattttagaactggcgactattttttctgaaatggttcaagggcaaaaagatgagcgtcaagaccaacttggagacgcggcattcttgtcaggtgttgccaaattccctcaaagaatcaagtgtgcaaccctagcttggaatgcccttaagaaaacaattgaaaatcaagaaaaacagtaa

SEQ ID NO: 307 - DNA, 1953 bp, Streptococcus pneumoniae
atgaaaattcaagacctattgagaaaagatgtcatgttgctagatttgcaggcaactgaaaaaacagctgtcatcgacgagatgattaaaaatttgacagaccacggttatgtaacagattttgaaacatttaaagaaggaattttggcgcgtgaagctttgacttctactggtttgggtgatggaatcgcaatgcctcacagcaaaaacgctgctgtcaaagaagcgacagttctatttgctaagtcaaataagggtgttgactacgagagcttggatggacaagcaactgacctcttcttcatgattgcagctccagaaggtgccaatgatactcacttggcagccttggcagaattgtctcaatacttgatgaaagacggttttgcagacaaacttcgtcaagcaacatctgcagaccaagttatcgaactttttgaccaagcttcagaaaaaactgaggaacttgttcaagcacctgctaatgactctggtgactttatcgtagctgttacagcttgtacaacaggtattgcccacacttacatggcccaagaagcccttcaaaaagtagctgctgaaatgggggttggtatcaaggtcgaaaccaacggtgctagcggtgttggaaatcaactaactgcagaagatatccgtaaggctaaagctattatcattgcagcagacaaggccgttgaaatggatcgatttgatggaaaaccattgatcaatcgtccagttgctgacggtatccgtaagacagaagagctaattaacttggctctttcaggagatactgaagtctaccgtgccgctaatggtgccaaagctgcaacagcctctaacgaaaaacaaagccttggtggtgccttgtacaaacacttgatgagtggtgtatctcaaatgttaccattcgttatcggtggtggtatcatgattgcccttgccttcttgattgacggtgctttgggtgttccaaatgaaaaccttggcaatcttggttcttaccatgagttagcttctatgttcatgaaaattggtggagctgcctttggtttgatgcttccagtctttgcgggttatgttgcctactctattgctgaaaaaccgggtttggtagcaggtttcgtggctggtgctattgccaaagaaggttttgcctttggtaaaattccttatgccgcaggtggtgaagcaacttcaactcttgcaggtgtctcatctggtttcctaggtgcccttgttggtggatttatcgcaggtgccttggttcttgccatcaagaaatacgttaaagttcctcgttcactcgaaggtgctaaatcaatccttctattgccacttcttggaacaatcttgacaggatttgttatgctagctgtgaatatcccaatggctgcaatcaacactgctatgaatgacttcctaggcggtcttggaggaggttcagctgtccttcttggtatcgtccttggtggaatgatggctgttgacatgggtggaccagttaataaagcagcttatgtctttggtacaggtacgcttgcagcaactgtttcttcaggtggttctgtagccatggcagcagttatggctggaggaatggtgccaccacttgcaatctttgtcgcaactcttcttttcaaagataaatttactaaggaagaacgtaactctggtttgacaaacatcatcatgggcttgtcatttatcactgagggagcgattccatttggtgccgctgacccagctcgtgcgattccaagcttcatccttggttcagcagtagcaggtggactcgttggtcttactggtatcaaactcatggcgccacacggaggaatcttcgttatcgcccttacttcaaatgctctcctttacctcgtttctgtcttggtaggagcaatcgtaagtggtgtggtttatggttacctacgcaaaccacaagcataa

SEQ ID NO: 308 - DNA, 2304 bp, Streptococcus pneumoniae
atggcaaacaagaatacaagtacaacaagacggagaccgtctaaagcagaactggaaagaaaagaagcgattcaacgaatgttgatttcgttaggaattgcgattttattgattttcgcagccttcaaattaggggctgcaggtataaccctttataatttaattcgcttgctagtgggtagcctagcttatctggcgatattcggcctattaatctatctcttctttttcaagtggatacgaaaacaggaaggactcttatctggctttttcaccatatttgctggcttactcttgatttttgaggcctacttggtttggaaatatggtttggacaagtccgttctaaaagggaccatggctcaggttgtgacagatctgactggttttcgaacgactagctttgctggagggggcttgatcggggtcgctctttatattccaacagcctttctcttttcaaatatcggaacttactttattggttctatcttgattttagtgggttctctcctagtcagcccttggtctgtttacgatattgctgaatttttcagtagaggctttgccaaatggtgggaagggcacgagcgtcgaaaagaggaacgctttgtcaaacaagaagaaaaagctcgccaaaaggctgagaaagaggctagattagaacaagaagagactgaaaaagccttactcgatttgcctcctgttgatatggaaacgggtgaaattctgacagaggaagctgttcaaaatcttccacctattccagaagaaaagtgggtggaaccagaaatcatcctgcctcaagctgaacttaaattccctgaacaggaagatgactcagatgacgaagatgttcaggtcgatttttcagccaaagaagcccttgaatacaaacttccaagcttacaactctttgcaccagataaaccaaaagatcagtctaaagagaagaaaattgtcagagaaaatatcaaaatcttagaagcaacctttgctagctttggtattaaggtaacagttgaacgggccgaaattgggccatcagtgaccaagtatgaagtcaagccggctgttggtgtaagggtcaaccgcatttccaatctatcagatgacctcgctctagccttggctgccaaagatgtccggattgaagcaccaatccctgggaaatccctaatcggaattgaagtgcccaactccgatattgccactgtatctttccgagaactatgggaacaatcgcaaacgaaagcagaaaatttcttggaaattcctttagggaaggctgttaatggaaccgcaagagcttttgacctttctaaaatgccccacttgctagttgcaggttcaacgggttcagggaagtcagtagcagttaacggcattattgctagcattctcatgaaggcgagaccagatcaagttaaatttatgatggtcgatcccaagatggttgagttatctgtttacaatgatattccccacctcttgattccagtcgtgaccaatccacgcaaagccagcaaggctctgcaaaaggttgtggatgaaatggaaaaccgttatgaactctttgccaaggtgggagttcggaatattgcaggttttaatgccaaggtagaagagttcaattcccagtctgagtacaagcaaattccgctaccattcattgtcgtgattgtggatgagttggctgacctcatgatggtggccagcaaggaagtggaagatgctatcatccgtcttgggcagaaggcgcgtgctgcaggtatccacatgattcttgcaactcagcgtccatctgttgatgtcatctctggtttgattaaggccaatgttccatctcgtgtagcatttgcggtttcatcaggaacagactcccgtacgattttggatgaaaatggagcagaaaaacttcttggtcgaggagacatgctctttaaaccgattgatgaaaatcatccagttcgtctccaaggctcctttatctcggatgacgatgttgagcgcattgtgaacttcatcaagactcaggcagatgcagactacgatgagagttttgatccaggtgaggtttctgaaaatgaaggagaattttcggatggagatgctggtggtgatccgctttttgaagaagctaagtctttggttatcgaaacacagaaagccagtgcgtctatgattcagcgtcgtttatcagttggatttaaccgtgcgacccgtctcatggaagaactggagatagcaggtgtcatcggtccagctgaaggtaccaaacctcgaaaagtgttacaacaataa

SEQ ID NO: 309 - DNA, 528 bp, Streptococcus pneumoniae
atgagttattttaaaaaatataaattcgataaatcccagttcaaacttggtatgcgaacctttaaaacaggtattgctgtttttctagttctcttgatttttggcttttttggctggaaaggtcttcaaattggtgctttgacagccgtttttagcctgagggagagttttgatgagagtgttcattttgggacttcgcgtattctaggaaatagtatcggtggactctatgccttggtcttcttcttattaaatacctttttccacgaagccttttgggtgaccttggtagttgttccaatctgcaccatgttaaccattatgacaaatgtagccatgaataacaaagcaggggttattggtggtgtagcagctatgttaatcattaccctatcaattccaagtggtgagacaattttgtacgtgtttgtgcgtgtattagaaacgtttatgggagtttttgtcgcaattatcgtaaattacgatattgatcgtattcgtctctttttagagaaaaaagaaaaataa

SEQ ID NO: 310 - DNA, 471 bp, Streptococcus pneumoniae
atgaataaatcagaacaccgccaccaacttatacgcgctcttatcacaaaaaacaagattcatacacaggctgagttgcaagcccttcttgctgagaacgacattcaagtaacccaggcaaccctctcacgcgacatcaaaaatatgaacctatcaaaagtccgcgaagaagatagcgcttattatgttcttaacaatggttccatctcaaaatgggaaaaacgtctcgaactctacatggaagacgcccttgtctggatgcgcccagttcaacaccaagtcctactaaaaacccttcctggactggctcaatcctttggttctatcattgatactttgagcttccctgacgctatcgctaccctttgtggtaatgatgtctgtcttatcatctgtgaagatgcagatactgctcaaaagtgctttgaagaactgaaaaaattcgccccaccatttttctttgaagaataa

SEQ ID NO: 311 - DNA, 1488 bp, Streptococcus pneumoniae
atgaaaagtataaaattaaatgctctatcttacatgggaattcgtgtcttgaatattatttttcccatcctaactggaacctatgtcgcgcgtgtcttggaccgaactgactatggttacttcaactcagtcgacactattttgtcatttttcttgccctttgcaacttatggtgtctataactacggtttaagggctatcagtaatgtcaaggataacaaaaaagatcttaacagaaccttttctagtcttttttatttgtgcatcgcttgtacgattttgaccactgctgtctatatcctagcctatcctctcttctttactgataatccaatcgtcaaaaaggtctaccttgttatggggattcaactcattgcccagattttttcaatcgaatgggtcaatgaagctctggaaaattacagttttctcttttacaaaactgccttcatccgtatcctgatgctggtctctattttcttatttgttaaaaatgaacacgatattgttgtctatacacttgtgatgagtttatcgacgctgattaactacctgattagttatttttggattaaaagagacatcaaacttgttaaaattcacctaagtgattttaaaccactctttctccctctgacagccatgttagtctttgccaatgccaatatgctcttcacttttttagatcgcctcttcctcgttaaaacagggattgatgtcaacgttagttactataccatagctcagcgaattgtgaccgttatagctggggttgtaacaggtgcaattggagtgagtgtgcctcgtctcagttactatctggggaaaggagacaaagaagcctatgtttctctggttaatagaggtagtcgaatctttaacttctttatcattccactgagttttggactcatggttttaggaccaaatgccatcctactttacggtagtgaaaaatatatcggaggcggcatcttgacctctctcttcgcttttcgtacgattatcctggccttagataccattcttggttcccaaattctctttaccaatggctatgaaaaacgtatcacagtctatacagtctttgctgggctactcaatttgggcttgaatagtctcctttttttcaaccatatcgtggctcctgaatactacttactgacaactatgctatcagagacttctctacttgttttctatatcattttcatccatagaaaacaactcatccacttgggacatatctttagctatactgttcgatactctctcttttcactttcctttgtagcaatttatttcctgattaatttcgtgtatcctgtagatatggtcattaatttgccatttttgattaatactggtttgattgtcttgctatcagctatctcttatattagtctacttgtcttcacaaaagatagcattttctatgaatttttaaaccatgtcctagccttaaaaaataaatttaaaaaatcatag

SEQ ID NO: 312 - DNA, 804 bp, Streptococcus pneumoniae
atgaaacaactaaccgttgaagatgccaaacaaattgaattagaaattttggattatattgatactctctgtaaaaagcacaatatcaactatattattaactacggtactctgattggggcggttcgacatgagggctttatcccttgggacgacgatattgatctgtccatgcctagagaagactaccaacgatttattaacatttttcaaaaggaaaaaagcaagtataagctcctatccttagaaactgataagaactactttaacaactttatcaagataaccgacagtacgactaaaattattgatactcgaaatacaaaaacctatgagtctggtatctttatcgatattttccctatagatcgctttgatgatcctaaggtcattgatacttgttataaactggaaagcttcaaactgctgtctttcagtaaacataaaaatattgtctataaggatagccttttaaaagattggatacgaacagccttctggttactccttcgaccggtttctcctcgttattttgcaaataaaatcgagaaagaaattcaaaaatatagtcgtgaaaatgggcaatatatggcttttatcccttcaaaatttaaggaaaaggaagtcttcccaagtggtacctttgataaaacaatcgatttaccctttgagaatttaagccttcctgcacctgaaaaatttgatactattttgacacaattttatggagattatatgaccctaccaccagaagaaaaacgcttctacagtcatgaatttcacgcttataaattggaggattag

SEQ ID NO: 313 - DNA, 1527 bp, Streptococcus pneumoniae
atgataaaaatcaatcatctaaccatcacacaaaacaaagatttacgagatcttgtatctgacctaaccatgaccatccaagacggggaaaaggttgctattattggtgaagaaggaaatggcaaatcaaccttacttaaaattttaatgggggaagctttgtctgatttcactatcaagggaaacatccaatctgactatcagtcactggcctacattcctcaaaaagtccctgaggacctaaaaaagaaaactttacacgactacttctttttagattctattgatttagactacagtatcctctatcgtttggcggaggaattgcattttgatagcaatcgtttcgcaagtgaccaagagattggcaatctatcagggggcgaagctttgaaaattcagcttatccatgagttagccaaaccctttgagattctatttttagatgaaccttcaaatgacctagaccttgagacagttgattggctaaaaggccagattcaaaagaccaggcaaaccgttattttcatttcccatgatgaagactttctttctgaaacggcagacactattgttcacttgcgactggtcaaacaccgtaaagaagcggaaacgctagtagagcatttagactatgatagctatagtgagcagagaaaggctaattttgccaaacaaagtcagcaagctgctaacaaccaaagagcctacgataaaaccatggaaaaacatcggagagttaagcaaaatgtagaaactgcgcttcgagctaccaaagatagtactgccggtcgcctattggctaaaaagatgaaaactgtcctctcacaagaaaaacgctacgaaaaggcagctcagtccatgactcaaaagccacttgaagaggaacaaatccaacttttcttttcagacatccaaccattaccagcttctaaagtcttagtccaactggaaaaagaaaatttgtccattgacgaccgagttttggttcaaaaactacaactaactgtccgtggccaagaaaaaatcggtattatcgggccaaatggtgttgggaaatcaactctgttagccaagttacagagacttctgaatgataaaagagagatttcacttggttttatgccacaagattaccacaaaaaactgcaattggatttatccccaatagcctatctcagtaaaactggggaaaaagaggaactacagaaaatccaatctcacctagctagtctcaatttcagttatccagaaatgcagcatcaaattcgctccttatctggcggacaacagggaaaactcctgcttttggatttagtcctgcgcaaaccaaactttctcctgctggatgaacccacacgaaacttttctcccacttctcaaccccaaatcagaaaactctttgctacctatccaggcggtctcatcactgtttcgcatgaccgtcgtttcttaaaagaagtctgctcgatcatctatcgcatgacagaacacggtttgaagctagttaatttagaagatttataa

SEQ ID NO: 314 - DNA, 714 bp, Streptococcus pneumoniae
atgaaaccaaaaacattttacaacttgcttgccgagcagaatcttccactttcggaccagcaaaaagaacaatttgaacgttattttgagctcttggtcgagtggaatgagaagattaatttgacggcgattacggacaaggaagaagtttatctcaaacatttttacgattcgattgcacccattcttcaaggtttgattcccaatgaaactatcaaacttcttgatatcggggctggggcaggatttcctagtctaccaatgaaaattctctatccggagttagatgtgaccattattgattcactcaataagcgcatcaacttcctacaactcttggctcaagaactggatttgaacggagttcatttctaccacggacgtgccgaagattttgcccaagacaagaacttccgtgctcaatatgattttgtaacagctcgtgcggttgcccgtatgcaggtcctatctgaattgactattccctaccttaaggttggtggcaaactattagcactcaaggctagcaatgcgcctgaggaattattagaagctaagaatgccctcaatctcctttttagtaaggtcgaagacaatctcagctacgccctaccgaatagagatccgcgctatatcacagtggtagaaaagaaaaaagaaacaccaaataaatatccacgtaaggctggtatgccaaataaacgcccactttaa

SEQ ID NO: 315 - DNA, 807 bp, Streptococcus pneumoniae
atgagtattaaactaattgccgttgatatcgacggaacccttgtcaacagccaaaaggaaatcactcctgaagttttttctgccatccaagatgccaaagaagctggtgtcaaagtcgtgattgcaactggccgccctatcgcaggcgttgccaaacttctagacgacttgcagttgagagacgagggggactatgtggtaaccttcaacggtgcccttgtccaagaaactgctacaggacatgagattatcagcgaatccttgacttatgaggattatctagatatggaattcctcagtcgcaagctcggtgtccacatgcatgccattaccaaggacggtatctatactgcaaatcgcaatatcggaaaatacactgtacacgaatcaaccctcgtcagcatgcctatcttctaccgtacccctgaagaaatggctggcaaagaaattgttaaatgtatgtttatcgatgaaccagaaattctcgatgctgcgattgaaaaaattccagcagaattttacgagcgctactccatcaacaaatctgctcctttctacctcgaactccttaaaaagaatgtagacaagggttcagccattactcacttggctgaaaaactcggattgaccaaagatgaaaccatggcaatcggtgatgaagaaaatgaccgtgccatgctggaagtcgttggaaaccccgttgtcatggaaaatggaaatccagaaatcaaaaaaatcgccaaatacatcaccaaaacaaatgacgaatccggcgttgcccatgccatccgaacatgggtactgtaa

SEQ ID NO: 316 - DNA, 561 bp, Streptococcus pneumoniae
atgacttggattattcttggagttatcgctcttattgttatttttgtgattgttagctataacggtttggttaaaaatcgtatgcaaaccaaggaggcttggagtcagattgatgttcagttgaaacgtcgcaatgacctcttgccaaacttgattgagactgtaaaaggttatgccaaatatgaaggttctacccttgaaaaggtggcagaactacgtaaccaagtggcggcagcgacttcaccagcagaagctatgaaagccagtgatgccctcactcgtcaggtttcaggtatttttgcagttgcagaaagctatccagatttgaaagctagtgctaactttgttaaattgcaagaggagttgacaaacacagaaaataaaatttcttactctcgtcaactctataacagtgttgtcagcaactacaatgtaaaattagaaactttcccgagcaatattatcgctggaatgtttggatttaaagcggcagatttccttcaaacacctgaagaggaaaagtcggttcctaaagttgattttagcggtttaggtgactaa

SEQ ID NO: 317 - DNA, 900 bp, Streptococcus pneumoniae
atgttgtttgatcaaattgcaagcaataaacgaaaaacctggattttgttgctggtatttttcctactcttagctcttgttggttatgcggttggttatctctttataagatctggacttggtggtttggttattgcactgattatcggctttatctacgctttgtctatgatttttcaatcgacagagattgtcatgtccatgaatggagcgcgtgaggtggatgagcaaacggcaccagacctctaccatgtagtggaagatatggctctggtcgctcagattcctatgccccgtgttttcatcattgatgatccagccttaaatgcctttgcgacaggttctaatcctcaaaatgcggctgttgctgcgacttcaggtctactagctatcatgaatcgtgaagaactagaagctgttatgggacatgaagtcagtcatattcgtaattatgatatccgtatttcgactattgcagttgcccttgctagtgctatcaccatgctttctagtatggcaggtcgtatgatgtggtggggtggagcaggtcgcagacgaagtgatgatgaccgagatggaaatggtcttgaaatcattatgctagtggtttccctactagctattgtactggcacctctcgctgcaaccttggttcagctcgctatttctcgtcagagggaatttctggcagatgcatctagtgtcgagctgactcgcaatccccagggaatgattaatgccctagataagttggacaatagcaaacctatgagtcgccacgtcgatgatgctagcagtgccctttatatcaatgatcctaagaaaggtggggggttccaaaaactcttttatacccacccacctatctcagaacggattgaacgtttaaaacagatgtaa

SEQ ID NO: 318 - DNA, 543 bp, Streptococcus pneumoniae
atgaaattaaatattcaagaaattcgtaagcagtctgaaggtttgaactttgaacaaacgttagatttagttgatgacctgcgtgcacgtaatcaagaaattttagatgtaaaagatatccttgcagttgggaaagtacaatatgaagaccgtatgtatttcttagattatcaactatcttataccattgttcttgcttcgagtcgcagtatggagccagttgagttagttgaatcttatccagtcacggaagttttcatggaaggcgcaactaaccagctagatcaagaagttttagatgatgacttggtcttgcccatcgaaaatggggagcttgaccttgctgagagtgtatcagacaatatcctgctaaacattcctatcaaggtcttgacggctgaagaagaagctggtcaaggatttatctcaggaaatgactggcaaatcatgacagaggaagaataccaagctcaaaaagcagtaaagaaagaagaaaacagtccttttgctggcttacaaggactatttgacggagatgaataa

SEQ ID NO: 319 - DNA, 861 bp, Streptococcus pneumoniae
atggagttatttatgaaaatcacaaactatgaaatctataagttaaaaaaatcaggtttgaccaatcaacagattttgaaagtgctagaatacggtgaaaatgttgatcaggagcttttgttgggtgatattgcagatatctcaggttgccgtaatccagccgtttttatggaacgttattttcagatagacgatgcgcatttgtcgaaagagtttcaaaaatttccatctttctctattttagatgactgttatccttgggatttgagtgaaatatatgatgcgcctgtacttttattttacaagggaaatcttgacctcctgaaattcccgaaggtagcggtcgtgggcagtcgtgcttgtagcaaacagggagctaagtcagttgaaaaagtcattcaaggcttggaaaatgaactggttattgtcagtggtctggccaagggcattgacacagcagctcatatggcagctcttcagaatggcggaaaaaccattgcagtgattggaacaggactggatgtgttttatcctaaagccaataaacgcttgcaagactacatcggcaatgaccatctggttctaagtgaatatggacctggtgaacaacctctgaaatttcattttcctgcccgtaatcgcatcattgctggactttgtcgtggtgtgattgtagcagaggctaagatgcgttcaggtagtctcattacgtgtgagcgagcaatggaagaaggacgcgatgtctttgctattcctggtagcattttagatggactatcagacggttgccatcatttgattcaagaaggagcaaaattggtcaccagtgggcaagatgttcttgcggaatttgaattttaa

SEQ ID NO: 320 - DNA, 534 bp, Streptococcus pneumoniae
atgaaacgtcaattagccttggtcgtctttagtggtggtcaagattcaacaacctgccttttctgggtcatgcaacactatgaaacagtcgaagctgtcacctttgcctacggccaacgtcatcacctcgaaattcaaattactagagaaatcgctaaggaacagggcattcgtcaccatatcctcgatatgtctctgctgggacaaatcactgctcagccagactttgcgacgattcatatttcctacattcctgacaagctctgtgtcgagtcaaaatccctcaaactatatctatttagctaccgaaaccacggagatttccacgaaaactgtatcaacaccatcgggaaagacttggtcaacttgctagaccctcgctatttagaagtctggggaaaattcactccgcgcggtggcatttcaatcgacccctactacaactacggtaagcaaggaactaagtatgagggcttggcagaacaacgcctcttccaacacgacctttatccagagaaaattgacaaccgctaa

SEQ ID NO: 321 - DNA, 3711 bp, Streptococcus pneumoniae
atgaccgaaacggtagaagataaagtaagtcattcaattactgggcttgatatcctcaaggggatagttgctgcgggagctgtcataagtggaaccgttgcaactcaaacgaaggtatttacaaatgagtcagcagtacttgaaaaaactgtagagaaaacggatgctttggcaacaaatgatacagtagttctaggtacgatatctacaagtaattcagcgagttcaactagtttgtcagcttcagagtcggcaagtacatctgcatctgagtcagcctcaaccagcgcttcgacctcagcaagtacaagtgcatcagaatcagcaagtacatcggcttcgacaagtatttctgcatcatctactgtggtaggttcacaaacagctgccgctacagaagcaactgctaagaaggtcgaagaagatcgtaagaaaccagctagtgattatgtagcatcagttacaaatgtcaatctccaatcttatgctaagcgacgcaagcgttcagtggattccatcgagcaattgctggcttctataaaaaatgctgctgttttttctggcaatacgattgtaaatggcgcccctgcaattaatgcaagtctaaacattgctaaaagtgagacaaaagtttatacaggtgaaggtgtagattcggtatatcgtgttccaatttactataaattgaaagtgacaaatgatggttcaaaattgacctttacctatacggttacgtatgtgaatcctaaaacaaatgatcttggtaatatatcaagtatgcgtcctggatattctatctataattcaggtacttcaacacaaacaatgttaacccttggcagtgatcttggtaaaccttcaggtgtaaagaactacattactgacaaaaatggtagacaggttctatcctataatacatctacaatgacgacgcagggtagtgggtatacttggggaaatggtgcccaaatgaatggtttctttgctaagaaaggatatggattaacatcatcttggactgtaccaattactggaacggatacatcctttacatttaccccttacgctgctagaacagatagaattggaattaactacttcaatggtggaggaaaggtagttgaatctagcacgaccagtcagtcactttcacagtctaagtcactctcagtaagtgctagtcaaagcgcctcagcttcagcatcaacaagtgcgtcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcaaccagtgcttcggcttcagcaagtaccagtgcttcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagcctcagcaagtatctcagcgtctgaatcggcatcaacgagtgcgtctgagtcagcatcaacgagtacgtcagcctcagcaagcacctcagcttctgaatcggcctcaaccagtgcgtcagcctcagcatcgacaagcgcctcagcttcagcaagtaccagtgcttcagcctcagcgtcgacaagtgcgtcggcctcaaccagtgcatctgaatcggcatcaaccagtgcgtcagcctcagcaagtactagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcttcagcatcaaccagcgcctcggcctcagcaagcacctcagcttctgaatcggcctcaaccagcgcctcggcctcagcaagcacctcagcttctgaatcggcctcaaccagcgcctcagcctcagcatcaacgagtgcttcggcttcagcaagcacaagcgcctcgggttcagcatcaacgagtacgtcagcttcagcgtcaaccagtgcttcagcctcagcatcaacaagtgcgtcagcctcagcaagtatctcagcgtctgaatcggcatcaacgagtgcgtctgagtcagcatcaacgagtacgtcagcctcagcaagcacctcagcttctgaatcggcctcaaccagtgcgtcagcctcagcatcgacaagcgcctcagcttcagcaagtaccagtgcttcagcctcagctcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcctcggcttcagcgtcaaccagtgcgtcagcttcagcaagtaccagtgcttcagtctcagcatcaacaagtgcttcagcctcagcatcgacaagtgcctcggcttcagcaagcacatcagcatctgaatcagcgtcgacaagcgcctcagcttcagcaagtaccagtgcgtcagcctcagcgtcgacaagtgcgtcagcctcagcaagtactagtgcatcagcttcagcatcaacgagtgcatcggcttcggcgtcaaccagtgcatcagagtcagcaagtaccagtgcgtcagcttccgcatcaacaagtgcctcggcttcagcaagcaccagtgcgtcggcttcagcaagtactagcgcctcagcctcagcctcaaccagtgcgtcagcctcagcaagtatctcagcgtctgaatcggcatcaacgagtgcgtccgcttcagcaagtactagcgcctcagcctcagcgtcaacaagtgcatcggcttcagcgtcaacgagtgcgtctgaatcggcatcaacgagtgcgtccgcttcagcaagtactagcgcctcagcctcagcgtcaacaagtgcatcggcttcagcatcaacgagtgcgtccgcttcagcaagtactagcgcctcagcctcagcgtcaacaagtgcatcggcttcagcgtcaacgagtgcgtctgagtcagcatcaacgagtgcgtcagcctcagcaagcacatcagcttctgaatctgcatcaaccagtgcgtcagcctcagcatcgacaagcgcctcagcttcagcaagtaccagtgcgtcagcctcagcgtcgacaagtgcgtcggcttcagcaagtaccagtgcgtcagcctcagcaagtaccagtgcgtcagcctcagcgtcgacaagtgcgtcggcctcaaccagtgcatctgaatcggcatcaaccagtgcgtcagcctcagcaagtactagtgcatcagcttcagcatcaacgagtgcatcggcttcagcatcaaccagtgcatcagagtcagcaagtaccagtgcgtcagttccgcatcaacaagtgcctcggcttcagcaagtactag

SEQ ID NO: 322 - DNA, 1350 bp, Streptococcus pneumoniae
atgggggtcgaaacttggttttattctagcatctgctggctggccatcgggcttggttccgtttggaagtttccctacatgactgctgctaatggcggtggaggctttttactaatctttctcatttccactattttaatcggtttccctctcctgctggctgagtttgcccttggccgtagtgctggcgtttccgctatcaaaacctttggaaaactgggcaagaataacaagtacaactttatcggttggattggcgcctttgccctctttatcctcttatctttttacagtgttatcggaggatggattctagtctatctaggtattgagtttgggaaattgttccaacttggtggaacgggtgattatgctcagttatttacttcaatcatttcaaatccagccattgccctaggagctcaagcggcctttatcctattgaatatcttcattgtatcacgtggggttcaaaaagggattgaaagagcttcgaaagtcatgatgcccctgctctttatcgtctttgtttttatcatcggtcgctctctcagtttgccaaatgccatggaaggggttctttacttcctcaaaccagacttttcaaaactgactagcactggtctcctctatgctctgggacaatctttctttgccctctcactaggggttacagtcatgttgacctatgcttcttacttagacaagaaaaccaatctagtccagtcaggaatctccatcgtagccatgaatatctcgatatccatcatggcaggtctagccattttccaagctcgatcccccttcaatatccagtctgaagggggacccagcctgctctttatcgtcttgcctcaactctttgacaagatgccttttggaaccattttctacgtcctcttcctcttgctcttcctttttgcgacagtcactttttctgtcgtgatgctggaaatcaatgtagacaatatcaccaaccaggataacagcaaacgtgccaaatggagtgttattttaggaattttgacctttgtctttggcattccttcagccctatcttacggtgtcatggcggatgttcacatttttggtaagaccttctttgacgctatggacttcttggtttccaatctcctcatgccatttggagctctctacctttcactttttacaggctatatctttaaaaaggctcttgcaatggaggaactccatctcgatgaaagagcatggaaacaaggactgttccaagtctggctcttccttcttcgtttcttcgtttcgtcattccaatcatcatcattgtggtcttcattgcccaatttatgtaatcaaaaaggacttgagtag

SEQ ID NO: 323 - DNA, 561 bp, Streptococcus pneumoniae
atgttgaaaaaatggcagttaaaagatgttatcttgcttgctttcttgtctatcttttttggtggggttttcgttggttcaggatatgtgtataatattctcagtctactcttaacacctcttggtttgcaggcctttgccaatgaaatcctcttcggtctctggtgtatggctgcgcccattgctgccatctttgttccgagagtcggaagtgcaacgattggagaagtgctagctgcgcttgctgaagtcctttatggtagccaatttggtctaggagctcttttgtctggctttgttcaaggtttgggaagtgaatttggttttatcgtaactaagaatcgctatgaaagttggctctctctaactgctaatagtattgggattacgcttgttagctttgtctatgaatacattaagttaggttactacgccttttcccttccgtttgtcctttccttgcttgtggtacgttttatttctgtttatttcttctgtaccatcttggttcgtgccattgtcaaactctatcatcagtttgcaactggaggaaaagcatag

SEQ ID NO: 324 - DNA, 651 bp, Streptococcus pneumoniae
atggtcaaagtagcaacccagacaccgattatcagtctcttcttgctgattttatccttggaaacatctttcattccttcgattgctctgactctttcggtagtcgcattttgtattctctttatgctctattaccgtcgatttaaaatgttagcttggatgatcatacttgccattttaccatcttttgccaactactgggcagttcagttacacggagatgcttcacaggcagtcatgcttggaacgagggcctttgtgacagtttgtatcggccttgtctttgtttcctctgtttcactaaaagagcttctcttgtacttggctcaaaaggggctatcacgctcttggtcctatgccttgattgtggtattcaattcttttcctctcattcagcaagaaatcaagtccctcaaagaagcttgcctattacgtggtcaagaactacatttttggtcgcccttgatttacagtaaggttctgatgacagtctttaggtggcgccatctttacctgagagctctatctgctcacggatatgacgaacatgcacagttgaagaatagctatcggactttttatattcctaaaaaaacaaaattaatctacctgcttttctttttattgcttcaaaccagtctatttttataa

SEQ ID NO: 325 - DNA, 525 bp, Streptococcus pneumoniae
atgagaaagcaccaattacaagttcacaaattaaccattttatctatgatgattgcccttgatgtagtccttacacctatctttcgaattgagggaatggcaccgatgtccagtgtagtcaatattctagcaggaatcatgatgggacctgtttatgccttggctatggctacagtcacagcctttatccgtatgacgactcaagggattccgcctttagctctcacaggagcgacttttggagcccttctagcaggtctcttttataagtacggtcgaaaatttcactattctgctctaggagagattttgggaacaggtattattggttccattgtttcctatcctgttatggtactctttacaggatcagctgctaagcttagctggtttatctacacgcctcgatttttcggagcaaccttgattggtacagcgatttcctttattgcctttcgatttttaatcaagcaggaattctttaaaaaagtgcagggatatttctttagtgaaaggatagactga

SEQ ID NO: 326 - DNA, 804 bp, Streptococcus pneumoniae
atgcaggaatttacaaatccctttcctataggctctagttccctcattcactgcattaccaatgagatttcttgtgagatgctggcaaatgggattttggctctgggatgcaaacctgtcatggcagatgattcccgtgaagttcttgattttactaagcaaagtcaggctctcttcatcaatttggggcatttgtcagctgagaaggaaaaagcaatccgcatggcagcttcgtatgcaaaccaatcttctctcccgatggtagtagatgcggttggcgtaacgacttcatccattcgtaagagcttagttaaagaccttttagactatagacctacggtccttaaaggaaacatgtcagaaattcgaagtcttgttggattaaagcaccacggcgttggggtcgatgcgagtgctaaagatcaagaaacggaggatttgcttcaagtcttgaaagactggtgtcagacctatcctggtatgtctttcttagtcacaggtcccaaggacctcgtcgtttcgaaaaatcaggtcgctgtactgggaaatggctgtactgaattagactggataacagggacaggagacttggttggagccttaacagctgtttttctcagccaaggaaagactggttttgaagcttcttgcttagcagtctcttatctcaatatcgctgctgagaaaatagttgttcaaggaatgggattggaagaatttcgttaccaagtactcaatcagctttcgctcctaagaagagatgaaaattggctagataccatcaaaggagaggtttatgaatag

SEQ ID NO: 327 - DNA, 834 bp, Streptococcus pneumoniae
atgaaccataaaatcgcaattttatcagatgttcatggcaatgcgacggcgctagaagcagtgattgcagatgctaaaaatcaaggggccagtgaatattggcttctgggagatatttttcttcctggtccaggcgcaaatgacttagtcgccctgctaaaggaccttcctatcacagcaagtgttcgaggcaattgggatgatcgtgtccttgaggctttagatgggcaatatggcttagaagacccacaggaagttcagctcttgcgtatgacacagtatttgatggagcgaatggatcctgcaacgattgtctggctacgaagcttgcctttgctggaaaagaaagaaattgacggattgcgcttttctatctctcataatttacctgacaaaaactatggtggtgacttgctagttgagaatgatacagagaaatttgaccaactgctagatgcggaaacggacgtggcagtttatggtcatgttcacaagcagttgcttcgttatggaagtcaagggcaacaaatcatcaatccagggtcgattggcatgccctattttaattgggaggcgttaaaaaatcaccgttcccagtatgccgtgatagaagttgaagatggggaattactcaatatccaatttcgtaaagttgcttatgattacgaagctgagttagaattggccaagtccaaggggcttccctttatcgaaatgtatgaagaactgcgtcgtgacgataactatcaggggcacaatctggaattattagccagcttaatagaaaagcatgggtatgtagaggatgtgaagaatttttttgattttttgtaa

SEQ ID NO: 328 - DNA, 726 bp, Streptococcus pneumoniae
atgaatgtaaatcagattgtacggattattcctactttaaaagctaataatagaaaattaaatgaaacattttatattgaaacccttggaatgaaggccttgttagaagaatcggcctttctgtcactaggtgaccaaacgggtcttgaaaagctggttttagaagaagctcccagtatgcgtactcgtaaggtagagggaagaaaaaaactagctagattgattgtcaaggtggaaaatcccttagaaattgaaggaatcttatctaaaacagattcgattcatcgattatataaaggtcaaaatggctacgcttttgaaattttctcaccagaagatgatttgattttgattcatgcggaagatgacatagcaagtctagtagaagtaggagaaaagcctgaatttcaaacagatttggcatcaatttctttaagtaaatttgagatttctatggaattacatctcccaactgatatcgaaagtttcttggaatcatctgaaattggggcatcccttgattttattccagctcaggggcaggatttgactgtggacaatacggttacctgggacttatctatgctcaagttcttggtcaatgaattagacatagcaagtcttcgccagaagtttgagtctactgaatattttattcctaagtctgaaaaattcttccttggtaaagatagaaataatgttgaattgtggtttgaagaagtatga

SEQ ID NO: 329 - DNA, 936 bp, Streptococcus pneumoniae
atgaagtggaccaagattattaaaaaaatagaagaacaaatcgaggcagggatttatcccggagcctcttttgcgtattttaaggacaatcaatggacagagttctatttaggccagagtgacccagagcatggcttgcagactgaggcaggactagtttatgacctagctagtgtcagcaaggttgttggggttggcacagtttgtaccttcttgtgggaaataggtcaattagatattgatagactggtaatagattttttacctgagagtgattatccagacatcactattcgccagctcttgactcatgcaacagaccttgatccttttattcctaatcgtgatcttttaacagcccctgaattaaaggaagcgatgtttcatctcaacagacgaagtcagccagcctttctttattcggatgtccattttttgctgttgggctttattttggaaagaatttttaatcaagatttggatgtgattttaaaggatcaagtctggaaaccttggggaatgacggaaactaagtttgggccagttgagcttgctgttccaacagttagaggtgtagaggcaggcatagtgcatgatcccaaggctcgtctcctgggtagacatgctgggagtgctggtttattttcgactataaaggatttacaaatctttttagaacactatttagcagatgattttgcaagagacttaaatcaaaatttttctcctttggatgacaaggaacgttctttagcatggaatttggaaggagattggctagaccatacgggctatacaggtacctttatcatgtggaatcgtcagaagcaagaagccactattttcctatcgaatcgtacctatgaaaaggacgagagagctcaatggatattagaccgcaatcaagtgatgaacttgattcgcaaagaagagtaa

SEQ ID NO: 330 - DNA, 483 bp, Streptococcus pneumoniae
atgatgaagaagacttataatcatattttggtctggggagtcattttctatagcatttgcattgtctgtttttgctttactcctcaagaacaatctaccgtgggagtgggaactccaggtattcagcatcttggacgcctggtttttcttttgactcctttcaattctctctggaaactgggcgaagtgagtgacattggacaattatgttggatttttttacaaaatatcctcaatgtcttcttgttttttcctctgattttccaactcctttatctatttccaaatttgcggaaaacaaaaaaggtccttctttttagttttcttgtgagtcttggaatcgagtgtacgcaattaatcttggactttttctttgatttcaatcgcgtctttgagattgatgatttgtggaccaacactttgggtggctatctggcttggctcctttataaacgattacataaaaacaaggtaaggaattaa

SEQ ID NO: 331 - DNA, 792 bp, Streptococcus pneumoniae
atgaagattcctctcttaacttttgcaaggcataaatttgtttatgtcttgcttactttgctttttcttgctttggtttatcgtgatgttttgatgacttatttcttttttgatattcatgcgcccgatctagctaaattcgatggacaagcaattaaaaatgacttattaaaatcagcattagattttcgtattctccagttcaatctaggtttttatcaatcatttattattccaatcatcattgttttgctaggttttcaatatattgagctgaaaaataaagttttacgattgagtattggaagagaagtgagttatcaagggttaaaaagaaagttgactttgcaagttgcaagtatcccttgtttgatatatttagtgactgtgctgataattgcaattataacctatttctttgggactttttctcctcttggatggaattctctattttctgatggaagtggtttacaaagactcctagatggagagataaaaagctatttgttctttacttgtgtcctactaatcggtattttcatcaatgcaatctattttttacaaatagttgattatgtggggaatgtgactcgttcggcaatcacctatttgatgtttctttggcttggttctatgctgctttatagtgccttgccttactatatggttcctatgacgagtttgatgcaagctagctatggggatgtaagtttgatgaaactctttactccttatatcctttatattgtcccttacatggtgcttgaaaaatatgaagataatgtttaa

SEQ ID NO: 332 - DNA, 651 bp, Streptococcus pneumoniae
atgaagataatgtttaagaattttaacaatattttgctaaatagaaagattgttttactacttcgtatagttctgatgatgattttgataaaccatctattgtcaacagcggttcaaaagcaggatgctgttatctttttcaagagagaattgatttcaattttttcctataatgactattctgaagcgaatttagaaatccccaaactattgttaaacctttcgcttttcatggtaggatggctctctgtcattttacttgaaagtgatttggcagaccattaccatcacttgattcgctatcaatcaagctcctttttcgattatacaaggaaacgattggttgtcatttctaaattttttactcaagatttgtttgtctggtttcttggtttacttcctctaggaattcatttcaaaacagtcgcacttttctttttacttgctcagttaatgatgttgtacttactactgtcttatctgatagcactgattagtgcgggcgctggtttttccttttttctctattttttagcatttgtgggacaagaatggatgatggatcatattgtaacagtgtatttagtactcttaagtttattagttatgttgattgttagtcgcttggaagagaaatttaagaaaggataa

SEQ ID NO: 333 - DNA, 525 bp, Streptococcus pneumoniae
atgggcaaaggagagatgggcaaaggagttattggcttggagttcgactcagaagtattggtcaacaaggctccaacccttcaattggcaaatggtaaaacagcgactttcctaacccagtatgatagcaagaccttgttgtttgcagtagataaggaagatatcggacaggaaattattggtatagctaaaggaagcatcgaaagtatgcataatcttcctgtaaatctagcaggtgccagagttcctggcggagtaaatggtagcaaagcagcggtgcatgaagttccagaatttacagggggagttaatggtacagagccagctgttcatgaaatcgcagagtataagggatctgattcgcttgtaactcttactacaaaaaaagattatacttacaaagctcctcttgctcagcaggcacttcctgaaacaggaaacaaggagagtgacctcctagcttcactaggactaacagctttcttccttggtctgtttacgctagggaaaaagagagaacaataa

SEQ ID NO: 334 - DNA, 1518 bp, Streptococcus pneumoniae
atgtttaaagttttacaaaaagttggaaaagcttttatgttacctatagctatacttcctgcagcaggtctacttttggggattggtggtgcactttcaaacccaaccacgatagcaacttatccaatactagacaatagtatttttcaatcaatattccaagtaatgagctctgcaggagaggttgtattcagtaatttgtcactacttctctgtgtgggattatgtattggcttagcgaaacgagataaaggaaccgctgcgttagcaggagtaactggttacttagttatgactgcaacgatcaaagctttggtaaaactttttatggcagaaggatctgcaattgatactggagttattggagcattagttgtcggaatagttgccgtatatttgcacaaccgatataacaatattcaattaccttccgctttaggattctttggaggttcacgcttcgttcctattgttacatcgttctcttctatcttgattggctttgtcttctttgttatttggccacctttccaacaacttcttgtttctacaggtggatatatttctcaggcgggtccaattggaacttttctatatggatttttaatgagactttctggagcagtaggcttacatcatataatttaccctatgttttggtatactgaacttggtggtgttgaaactgttgcaggacaaacagtggttggagctcaaaaaatattttttgctcaattagccgatttggcccattctggattatttacagaaggaacaaggttttttgcaggtcgtttctcaacaatgatgttcggtttaccggctgcctgtttagcgatgtaccatagtgttcctaaaaatcgtcgtaaaaaatacgcgggtttgttttttggagttgctttaacatcttttattaccggtattacagaaccaattgaatttatgtttctattcgtcagtccggttctatatgttgttcacgcattccttgatggtgttagcttctttattgcagacgtcttaaatatttcaataggaaacacattttcaggaggtgtaatcgatttcactttatttggaattttgcaggggaacgctaagacgaattgggttcttcagattccatttggacttatttggagtgttttgtattatattatttttagatggttcattactcaattcaacgttctaacgccagggcgaggagaagaagtagattctaaagaaatttctgaatccgcagattcaacttcaaatactgcagattatttaaaacaggatagcctacaaattatcagagccttgggtggatcaaataatatagaagatgtagatgcttgtgtgacacgtttacgtgtagctgtaaaagaagttaatcaagttgataaagcacttttaaaacaaattggtgcagttgatgtcttagaagtgaagggtggcattcaagcaatctatggagcaaaagcaatcttatataaaaatagtattaatgaaattttaggtgtagatgattaa

SEQ ID NO: 335 - DNA, 1329 bp, Streptococcus pneumoniae
atgaaatttagaaaattagcttgtacagtacttgcgggtgctgcggttcttggtcttgctgcttgtggcaattctggcggaagtaaagatgctgccaaatcaggtggtgacggtgccaaaacagaaatcacttggtgggcattcccagtatttacccaagaaaaaactggtgacggtgttggaacttatgaaaaatcaatcatcgaagcgtttgaaaaagcaaacccagatataaaagtgaaattggaaaccatcgacttcaagtcaggtcctgaaaaaatcacaacagccatcgaagcaggaacagctccagacgtactctttgatgcaccaggacgtatcatccaatacggtaaaaacggtaaattggctgagttgaatgacctcttcacagatgaatttgttaaagatgtcaacaatgaaaacatcgtacaagcaagtaaagctggagacaaggcttatatgtatccgattagttctgccccattctacatggcaatgaacaagaaaatgttagaagatgctggagtagcaaaccttgtaaaagaaggttggacaactgatgattttgaaaaagtattgaaagcacttaaagacaagggttacacaccaggttcattgttcagttctggtcaagggggagaccaaggaacacgtgcctttatctctaacctttatagcggttctgtaacagatgaaaaagttagcaaatatacaactgatgatcctaaattcgtcaaaggtcttgaaaaagcaactagctggattaaagacaatttgatcaataatggttcacaatttgacggtggggcagatatccaaaactttgccaacggtcaaacatcttacacaatcctttgggcaccagctcaaaatggtatccaagctaaacttttagaagcaagtaaggtagaagtggtagaagtaccattcccatcagacgaaggtaagccagctcttgagtaccttgtaaacgggtttgcagtattcaacaataaagacgacaagaaagtcgctgcatctaagaaattcatccagtttatcgcagatgacaaggagtggggacctaaagacgtagttcgtacaggtgctttcccagtccgtacttcatttggaaaactttatgaagacaaacgcatggaaacaatcagcggctggactcaatactactcaccatactacaacactattgatggatttgctgaaatgagaacactttggttcccaatgttgcaatctgtatcaaatggtgacgaaaaaccagcagatgctttgaaagccttcactgaaaaagcgaacgaaacaatcaaaaaagctatgaaacaatag

SEQ ID NO: 336 - DNA, 840 bp, Streptococcus pneumoniae
atgcaatctacagaaaaaaaaccattaacagcctttactgttatttcaacaatcattttgctcttgttgactgtgctgttcatctttccattctactggattttgacaggggcattcaaatcacaacctgatacaattgttattcctcctcagtggttccctaaaatgccaaccatggaaaacttccaacaactcatggtgcagaaccctgccttgcaatggatgtggaactcagtatttatctcattggtaaccatgttcttagtttgtgcaacctcatctctagcaggttatgtattggctaaaaaacgtttctatggtcaacgcattctatttgctatctttatcgctgctatggcgcttccaaaacaagttgtccttgtaccattggtacgtatcgtcaacttcatgggaatccatgatactctctgggcagttatcttgcctttgattggatggccattcggtgtcttcctcatgaaacagttcagtgaaaatatccctacagagttgcttgaatcagctaaaatcgacggttgtggtgagattcgtaccttctggagtgtagccttcccgattgtgaaaccagggtttgcagcccttgcaatctttaccttcatcaatacttggaatgactacttcatgcaattggtaatgttgacttcacgtaacaatttgaccatctcacttggggttgcgaccatgcaggctgaaatggcaaccaactatggtttgattatggcaggagctgcccttgctgctgttccaatcgtcacagtcttcctagtcttccaaaaatccttcacacagggtattactatgggagcggtcaaaggataa

SEQ ID NO: 337 - DNA, 1890 bp, Streptococcus pneumoniae
atgaaaaaaacttttttcttactggtgttaggcttgttttgccttcttccactctctgtttttgccattgatttcaagataaactcttatcaaggggatttgtatattcatgcagacaatacggcagagtttagacagaagatagtttaccagtttgaggaggactttaagggccaaatcgtgggacttggacgtgctggtaagatgcctagcgggtttgacattgaccctcatccaaagattcaggccgcgaaaaacggtgcagaactagcagatgtgactagcgaagtaacagaagaagcggatggttatactgtgagagtctataatccaggtcaggagggcgacatagttgaagttgacctcgtctggaacttaaaaaatttacttttcctttatgatgatatcgctgaattaaattggcaacctctgacagatagttcagagtctattgaaaagtttgaatttcatgtaaggggagacaagggggctgaaaaactctttttccatacagggaaactttttagagagggaacgattgaaaagagtaaccttgattatactatccgtttagacaatcttccggctaagcgtggagttgagttgcatgcctattggcctcggaccgattttgctagcgctagggatcagggattgaaagggaatcgtttagaagagtttaataagatagaagactcgattgttagagaaaaagatcagagtaaacaactcgttacttgggtcctcccttcgatcctttccatctccttgttattgagtgtctgcttctattttatttatagaagaaagaccactccttcagtcaaatatgccaaaaatcatcgtctctatgaaccaccaatggaattagagcctatggttttatcagaagcagtctactcgacctccttggaggaagtgagtcccttggtcaagggagctggaaaattcacctttgatcaacttattcaagctaccttgctagatgtgatagaccgtgggaatgtctctatcatttcagaaggagatgcagttggtttgaggctagtaaaagaagatggtttgtcaagctttgagaaagactgcctaaatctagctttttcaggtaaaaaagaagaaactctttccaatttgtttgcggattacaaggtatctgatagtctttatcgtagagccaaagtttctgatgaaaaacggattcaagcaagagggcttcaactcaaatcttcttttgaagaggtattgaaccagatgcaagaaggagtgagaaaacgagtttccttctgggggctcccagattattatcgtcctttaactggtggggaaaaggccttgcaagtgggtatgggtgccttgactatcctgcccctatttatcggatttggtttgttcttgtacagtttagacgttcatggctatctttacctccctttgccaatacttggttttctagggttagttttgtctgttttctattattggaagcttcgactagataatcgtgatggtgttctaaatgaagcgggagctgaggtctactatctctggaccagttttgaaaatatgttgcgtgagattgcacgattggatcaggctgaactggaaagtattgtggtctggaatcgcctcttggtctatgcgaccttatttggctatgcggacaaggttagtcatttgatgaaggttcatcagattcaagtggaaaatccagatatcaatctctatgtagcttatggctggcacagtacgttttatcattcaacagcacaaatgagccattatgctagtgtcgcaaatacagcaagcacctactctgtatcttctggaagtggaagttctggtggtggcttctctggaggcggaggtggcggcagtatcggtgccttttaa

SEQ ID NO: 338 - DNA, 2661 bp, Streptococcus pneumoniae
atgaaaaaagtaagaaagatatttcagaaggcagttgcaggactgtgctgtatatctcagttgacagctttttcttcgatagttgctttagcagaaacgcctgaaaccagtccagcgataggaaaagtagtgattaaggagacaggcgaaggaggagcgcttctaggagatgccgtctttgagttgaaaaacaatacggatggcacaactgtttcgcaaaggacagaggcgcaaacaggagaagcgatattttcaaacataaaacctgggacatacaccttgacagaagcccaacctccagttggttataaaccctctactaaacaatggactgttgaagttgagaagaatggtcggacgactgtccaaggtgaacaggtagaaaatcgagaagaggctctatctgaccagtatccacaaacagggacttatccagatgttcaaacaccttatcagattattaaggtagatggttcggaaaaaaacggacagcacaaggcgttgaatccgaatccatatgaacgtgtgattccagaaggtacactttcaaagagaatttatcaagtgaataatttggatgataaccaatatggaatcgaattgacggttagtgggaaaacagtgtatgaacaaaaagataagtctgtgccgctggatgtcgttatcttgctcgataactcaaatagtatgagtaacattcgaaacaagaatgctcgacgtgcggaaagagctggtgaggcgacacgttctcttattgataaaattacatctgattcagaaaatagggtagcgcttgtgacttatgcttccactatctttgatgggaccgagtttacagtagaaaaaggggtagcagataaaaacggaaagcgattgaatgattctcttttttggaattatgatcagacgagttttacaaccaataccaaagattatagttatttaaagctgactaatgataagaatgacattgtagaattaaaaaataaggtacctaccgaggcagaagaccatgatggaaatagattgatgtaccaattcggtgccacttttactcagaaagctttgatgaaggcagatgagattttgacacaacaagcgagacaaaatagtcaaaaagtcattttccatattacggatggtgtcccaactatgtcgtatccgattaattttaatcatgctacgtttgctccatcatatcaaaatcaactaaatgcattttttagtaaatctcctaataaagatggaatactattaagtgattttattacgcaagcaactagtggagaacatacaattgtacgcggagatgggcaaagttaccagatgtttacagataagacagtttatgaaaaaggtgctcctgcagctttcccagttaaacctgaaaaatattctgaaatgaaggcggctggttatgcagttataggcgatccaattaatggtggatatatttggcttaattggagagagagtattctggcttatccgtttaattctaatactgctaaaattaccaatcatggtgaccctacaagatggtactataacgggaatattgctcctgatgggtatgatgtctttacggtaggtattggtattaacggagatcctggtacggatgaagcaacggctactagttttatgcaaagtatttctagtaaacctgaaaactataccaatgttactgacacgacaaaaatattggaacagttgaatcgttatttccacaccatcgtaactgaaaagaaatcaattgagaatggtacgattacagatccgatgggtgagttaattgatttgcaattgggcacagatggaagatttgatccagcagattacactttaactgcaaacgatggtagtcgcttggagaatggacaagctgtaggtggtccacaaaatgatggtggtttgttaaaaaatgcaaaagtgctctatgatacgactgagaaaaggattcgtgtaacaggtctgtaccttggaacggatgaaaaagttacgttgacctacaatgttcgtttgaatgatgagtttgtaagcaataaattttatgataccaatggtcgaacaaccttacatcctaaggaagtagaacagaacacagtgcgcgacttcccgattcctaagattcgtgatgtgcggaagtatccagaaatcacaatttcaaaagagaaaaaacttggtgacattgagtttattaaggtcaataaaaatgataaaaaaccactgagaggtgcggtctttagtcttcaaaaacaacatccggattatccagatatttatggagctattgatcaaaatggcacttatcaaaatgtgagaacaggtgaagatggtaagttgacctttaaaaatctgtcagatgggaaatatcgattatttgaaaattctgaaccagctggttataaacccgttcaaaataagcctatcgttgccttccaaatagtaaatggagaagtcagagatgtgacttcaatcgttccacaagatataccagcgggttacgagtttacgaatgataagcactatattaccaatgaacctattcctccaaagagagaatatcctcgaactggtggtatcggaatgttgccattctatctgataggttgcatgatgatgggaggagttctattatacacacggaaacatccgtaa

SEQ ID NO: 339 - DNA, 1998 bp, Streptococcus pneumoniae
atgaaatcaatcaacaaatttttaacaatgcttgctgccttattactgacagcgagtagcctgttttcagctgcaacagtttttgcggctgggacgacaacaacatctgttaccgttcataaactattggcaacagatggggatatggataaaattgcaaatgagttagaaacaggtaactatgctggtaataaagtgggtgttctacctgcaaatgcaaaagaaattgccggtgttatgttcgtttggacaaatactaataatgaaattattgatgaaaatggccaaactctaggagtgaatattgatccacaaacatttaaactctcaggggcaatgccggcaactgcaatgaaaaaattaacagaagctgaaggagctaaatttaacacggcaaatttaccagctgctaagtataaaatttatgaaattcacagtttatcaacttatgtcggtgaagatggagcaaccttaacaggttctaaagcagttccaattgaaattgaattaccattgaacgatgttgtggatgcgcatgtgtatccaaaaaatacagaagcaaagccaaaaattgataaagatttcaaaggtaaagcaaatccagatacaccacgtgtagataaagatacacctgtgaaccaccaagttggagatgttgtagagtacgaaattgttacaaaaattccagcacttgctaattatgcaacagcaaactggagcgatagaatgactgaaggtttggcattcaacaaaggtacagtgaaagtaactgttgatgatgttgcacttgaagcaggtgattatgctctaacagaagtagcaactggttttgatttgaaattaacagatgctggtttagctaaagtgaatgaccaaaacgctgaaaaaactgtgaaaatcacttattcggcaacattgaatgacaaagcaattgtagaagtaccagaatctaatgatgtaacatttaactatggtaataatccagatcacgggaatactccaaagccgaataagccaaatgaaaacggcgatttgacattgaccaagacatgggttgatgctacaggtgcaccaattccggctggagctgaagcaacgttcgatttggttaatgctcagactggtaaagttgtacaaactgtaactttgacaacagacaaaaatacagttactgttaacggattggataaaaatacagaatataaattcgttgaacgtagtataaaagggtattcagcagattatcaagaaatcactacagctggagaaattgctgtcaagaactggaaagacgaaaatccaaaaccacttgatccaacagagccaaaagttgttacatatggtaaaaagtttgtcaaagttaatgataaagataatcgtttagctggggcagaatttgtaattgcaaatgctgataatgctggtcaatatttagcacgtaaagcagataaagtgagtcaagaagagaagcagttggttgttacaacaaaggatgctttagatagagcagttgctgcttataacgctcttactgcacaacaacaaactcagcaagaaaaagagaaagttgacaaagctcaagctgcttataatgctgctgtgattgctgccaacaatgcatttgaatgggtggcagataaggacaatgaaaatgttgtgaaattagtttctgatgcacaaggtcgctttgaaattacaggccttcttgcaggtacatattacttagaagaaacaaaacagcctgctggttatgcattactaactagccgtcagaaatttgaagtcactgcaacttcttattcagcgactggacaaggcattgagtatactgctggttcaggtaaagatgacgctacaaaagtagtcaacaaaaaaatcactatcccacaaacgggtggtattggtacaattatctttgctgtagcgggggctgcgattatgggtattgcagtgtacgcatatgttaaaaacaacaaagatgaggatcaacttgcttaa

SEQ ID NO: 340 - DNA, 1173 bp, Streptococcus pneumoniae
atgacaatgcagaaaatgcagaaaatgattagtcgtatcttctttgttatggctctgtgtttttctcttgtatggggtgcacatgcagtccaagcgcaagaagatcacacgttggtcttgcaattggagaactatcaggaggtggttagtcaattgccatctcgtgatggtcatcggttgcaagtatggaagttggatgattcgtattcctatgatgatcgggtgcaaattgtaagagacttgcattcgtgggatgagaataaactttcttctttcaaaaagacttcgtttgagatgaccttccttgagaatcagattgaagtatctcatattccaaatggtctttactatgttcgctctattatccagacggatgcggtttcttatccagctgaatttctttttgaaatgacagatcaaacggtagagcctttggtcattgtagcgaaaaaaacagatacaatgacaacaaaggtgaagctgataaaggtggatcaagaccacaatcgcttggagggtgtcggctttaaattggtatcagtagcaagagatgtttctgaaaaagaggttcccttgattggagaataccgttacagttcttctggtcaagtagggagaactctctatactgataaaaatggagagatttttgtgacaaatcttcctcttgggaactatcgtttcaaggaggtggagccactggcaggctatgctgttacgacgctggatacggatgtccagctggtagatcatcagctggtgacgattacggttgtcaatcagaaattaccacgtggcaatgttgactttatgaaggtggatggtcggaccaatacctctcttcaaggggcaatgttcaaagtcatgaaagaagaaagcggacactatactcctgttcttcaaaatggtaaggaagtagttgtaacatcagggaaagatggtcgtttccgagtggaaggtctagagtatgggacatactatttatgggagctccaagctccaactggttatgttcaattaacatcgcctgtttcctttacaatcgggaaagatactcgtaaggaactggtaacagtggttaaaaataacaagcgaccacggattgatgtgccagatacaggggaagaaacccttgtatatcttgatgcttgttgccattttgttgtttggtag

SEQ ID NO: 341 - DNA, 1566 bp, Streptococcus pneumoniae
atgagccacatatacttatctattttcacaagtctcttgctgatgctaggacttgtcaatgttgctcaagccgatgaatatttacgcatcggtatggaagcagcatatgctccctttaactggacccaggatgatgatagcaacggagctgtcaaaatcgatgggaccaatcagtatgccaacggatacgatgttcaaatcgccaagaaaatcgctaaggacttaggtaaagaacctttggttgttaaaaccaagtgggaaggtctagtccctgcccttacttctggtaagattgacatgattatcgcaggtatgagtccaactgcagaacgcaaacaagaaattgccttttcgagcagttactatactagcgaaccagttttgcttgtcaaaaaagattctgcctacgcaagtgctaaatctttggatgactttaacggtgcaaaaatcacttctcaacaaggggtctacctttataacttgattgcacaaatcccaggtgctaaaaaagaaacagccatgggagacttcgctcaaatgcgacaagctcttgaggctggtgtcattgatgcttatgtttctgaacgtccagaagcactgactgctgaagctgcgaactctaagttcaagatgattcaagtagaacctggtttcaaaactggggaagaagatacagctatcgctatcgggcttcgtaaaaatgacaatcgtattagccaaatcaatgccagcattgaaaccatttcaaaagatgaccaagttgccttgatggatcgtatgatcaaggaacaacctgccgaagctacaacaactgaagagactagcagtagtttctttagccaagttgctaaaattctttctgaaaactggcaacaactcttgcgtggtgctggtatcactcttttaatctctatcgtcggaaccatcataggtctcattattggacttgccattggtgtcttccgtactgctcctctctctgaaaacaaagtcatttacggcctacaaaaactagtcggctgggttctcaatgtctacattgaaattttccgtggtacgccaatgattgttcaatcgatggttatctactatggaactgcccaagctttcgggatcaaccttgaccgtacactggctgctatcttcatcgtttcaatcaataccggtgcctacatgactgaaatcgtccgtggtggtatcctagcagttgacaagggacaatttgaagctgcgactgctcttggtatgacccataaccagaccatgcgtaagattgtcctacctcaggtagtccgtaacatcctacctgcaactggtaatgaatttgtcatcaatatcaaagatacatctgtattgaacgttatctctgttgtcgaactttatttctcaggaaataccgtggcaacacaaacctatcaatacttccagacatttacaatcatcgccgtgatttactttgtcctcaccttcaccgtaacacgtatcctacgctttatcgagcgcagaatggacatggatacctacactacaggtgctaaccaaatgcaaacggaggatttgaaataa

SEQ ID NO: 342 - DNA, 741 bp, Streptococcus pneumoniae
atgacacaagcaatccttgaaattaaacacctcaaaaaatcctatggacaaaacgaagtgctaaaagacatttcactcactgtccacaagggagaggtcatctctatcatcggaagctctggaagcggaaaatcgaccttcctacgctccattaacctacttgaaacaccaactgatggacaaatcctttatcatggacaaaacgtcctcgaaaaaggctatgacctcacgcaataccgtgaaaagttggggatggttttccaatcctttaacctctttgaaaatctcaatgttcttgaaaacacaatcgtcgctcagacaactgtcctaaaacgcgaacgcacagaagctgaaaagattgccaaagaaaacctggaaaaggtcggcatgggagaacgctactggcaagccaaaccaaaacaactctcaggtggtcaaaaacaacgtgtggccatcgctcgtgccctctccatgaatccggacgctattctctttgatgaaccaacatcagctctcgatccagaaatggttggagaagtcctcaaaatcatgcaggacctggctcaggaaggcttgaccatgattgtcgtaacccatgaaatggaatttgcccgtgatgtctctcaccgtgttatctttatggataagggcgtgatcgctgaagaaggtaaaccagaagacctcttcaccaatcctaaagaagaccgaacaaaagagttccttcaacgctatctcaaataa

SEQ ID NO: 343 - DNA, 690 bp, Streptococcus pneumoniae
atgaaaaagtatcaacttctattcaaaataagtgcagtcttctcttacttatttttcgtatttagtctttctcagctgacgcttatcgtccaaaactattggcaattttcttctcagataggcaatttattctggattcaaaatatcttgagtttactttttattggagtcatgattgtggttcttgttaagacaggccatggttatctcttccgcattccaagaaaaaaatggctttggtattcgattttgacagtattagtgctagtgttccagatctcttttaacgttcagacagctaaacatgttcagtcaactgcggaaggttgggctgtattgattggttatagtgggactaactttgcagagctaggtatttatatagccctgttctttctggttccactgatggaagaattgatttatagaggattactgcaacatgctttctttaagcattcgcgatttggtcttgatttgcttcttccttctattttatttgctctccctcatttttcaagcctgcctagtctgttagatatcttcgtctttgcaacagttggaatcatctttgctggtttgacccgctataccaagagcatttatccatcctatgcggtgcatgtgatcaataatattgtagcgaccttcccgtttttgctcacttttctacatagggtcttggggtaa

SEQ ID NO: 344 - DNA, 1040 bp, Streptococcus pneumoniae
atgaacaagaaacaatggctaggtcttggcctagttgcagtggcagcagttggacttgctgcatgtggtaaccgctcttctcgtaacgcagcttcatcttctgatgtgaagacaaaagcagcaatcgtcactgatactggtggtgttgatgacaaatcattcaaccaatcagcttgggaaggtttgcaggcttggggtaaagaacacaatctttcaaaagataacggtttcacttacttccaatcaacaagtgaagctgactacgctaacaacttgcaacaagcggctggaagttacaacctaatcttcggtgttggttttgcccttaataatgcagttaaagatgcagcaaaagaacacactgacttgaactatgtcttgattgatgatgtgattaaagaccaaaagaatgttgcgagcgtaactttcgctgataatgagtcaggttaccttgcaggtgtggctgcagcaaaaacaactaagacaaaacaagttggttttgtaggtggtatcgaatctgaagttatctctcgttttgaagcaggattcaaggctggtgttgcgtcagtagacccatctatcaaagtccaagttgactacgctggttcatttggtgatgcggctaaaggtaaaacaattgcagccgcacaatacgcagccggtgcagatattgtttaccaagtagctggtggtacaggtgcaggtgtctttgcagaggcaaaatctctcaacgaaagccgtcctgaaaatgaaaaagtttgggttatcggtgttgatcgtgaccaagaagcagaaggtaaatacacttctaaagatggcaaagaatcaaactttgttcttgtatctactttgaaacaagttggtacaactgtaaaagatatttctaacaaggcagaaagaggagaattccctggcggtcaagtgatcgtttactcattgaaggataaaggggttgacttggcagtaacaaacctttcagaagaaggtaaaaaagctgtcgaagatgcaaaagctaaaatccttgatggaagcgtaaaagt

SEQ ID NO: 345 - DNA, 1059 bp, Streptococcus pneumoniae
atgtctaaaaaattacaacaaatttcggttcccttgatttctgtattcctaggaattttactcggagccattgtcatgtggatcttcggttatgatgctatttggggctacgaagaattgttctatacagcctttggcagtctgcgtgggattggagaaatcttccgtgctatgggtcctctggtcttgattggtcttggttttgccgttgccagtcgagctggtttctttaacgtcggacttcctggtcaggctttggcaggttggattctcagtggttggtttgccctgtcgcatccagatatgccccgtcccttgatgattctagcaaccatcgtgattgccttgattgctggtgggattgtcggagcgattccaggtattcttagggcctatctagggacgtcagaggttattgtaaccatcatgatgaactacattgtcttgtatgtagggaatgcctttatccatgctttccctaaagacttcatgcaaagtacagattcgaccattcgtgttggggctaatgcaacctatcagacaccttggttggctgagttgactggtaactcacggatgaatattggtattttctttgccatcattgccgttgcagttatttggttcatgctcaagaaaacaactcttggttttgaaatccgtgcagttggtcttaatccacatgcttcagaatatgctggtatttctgccaagcggactattatcctatctatgattatttcaggtgccttggcaggtcttggtggagctgttgaaggtttgggaaccttccagaacgtctatgttcaaggttcgtcattagctatcggatttaacggaatggcggttagtttgcttgcggccaactcaccaattggtatactctttgcagccttcctatttggcgttctccaagttggggctcctggtatgaatgcggcgcaggtaccatctgagcttgtcagcattgtaacagcgtctattatcttctttgtcagtgttcattaccttatcgaacgctttgtcaaaccgaaaaaacaagttaaaggaggtaagtaa

SEQ ID NO: 346 - DNA, 831 bp, Streptococcus pneumoniae
atgggagtgaaaaagaaactaaagttgactagtttgctaggactgtctctgttaatcatgacagcctgtgcgactaatggggtaactagcgatattacagccgaatcggctgatttttggagtaaattggtttacttctttgcggaaatcattcgctttttatcgtttgatattagtatcggagtggggattattctctttacggtcttgattcgtacagtcctcttgccagtctttcaggtgcaaatggtggcttctaggaaaatgcaggaagctcagccacgcattaaggcgcttcgagaacaatatccaggtcgagatatggaaagcagaaccaaactagagcaggaaatgcgtaaagtatttaaagaaatgggtgtcagacagtcagactctctttggccgattttgattcagatgccggttattttggccctgttccaagccctatcaagagttgactttttaaagacaggtcatttcttatggattaaccttggtagtgtggatacaacccttgttcttccgattttagcagcagtattcacctttttaagtacttggttgtccaacaaagctttgtctgagcgaaatggcgctacgactgcgatgatgtatgggattccagtcttgatttttatctttgcagtttatgcgccaggtggagtcgccctatactggacagtgtctaatgcttatcaagtcttgcaaacctatttcttgaataatccattcaagattatcgcagagcgcgaggccgtagtacaggcacaaaaagatttggaaaatagaaaaagaaaagccaagaaaaaggctcagaaaacgaaataa

SEQ ID NO: 347 - DNA, 795 bp, Streptococcus pneumoniae
atggttatcgatccatttgctatcaacgaactagactattacttagtttcacacttccacagtgatcatatcgacccatacacagctgcagcaattctcaataatcctaagttagagcatgttaagtttatcggtccttaccactgtggacgaatctgggaaggatggggtgttccaaaagaacgtatcatcgttgttaaaccaggtgacactatcgaattaaaagatatgaagattcatgcagtagaatcatttgaccgtacttgcttggtaactctcccagtgaacggtgctgatgagacaggcggtgaacttgctggcttggctgttacagatgaagaaatggctcaaaaggctgttaactatatctttgaaacaccaggtggaaccatctatcatggtgcagattctcacttctcaaactattttgcaaaacatggtaaagactttaaaattgatgttgctttgaataactatggtgaaaatccggtaggtatccaagacaaaatgacatctatcgaccttcttcgtatggcagaaaatctgcgtaccaaagtcattatcccagttcactatgatatctggtctaacttcatggcttctactaatgagattctagaactttggaaaatgcgaaaagatcgcttgcaatacgatttccatccatttatctgggaagttggcggtaagtacacttatcctcaagatcaacacttagtagaataccatcatccacgtggttttgatgattgttttgaacaagactctaacattcaatttaaagctttgctataa

SEQ ID NO: 348 - DNA, 585 bp, Streptococcus pneumoniae
atgttcctttcaggctggttgtctagttttgctaatacttatatccatgatttactgggggttcttttcccagatagtccatttttaaatgcctttgaaagtgctattgcggctcctttggtagaagaacccttgaaattattgtcacttgtttttgttttggctttgattcctgtgcgaaaattaaaatctttgtttttacttggaattgcttccggtttgggattccaaatgattaaggatattggttatattcgtacggatttgccagagggctttgactttactatttcgcgaattttagagcgtatcatctcaggaattgcctctcactggactttttcaggtctagctgtagtaggtgtttacttgctttacagagcctataaaggacagaaggttggcaagaaacagggccttatttttctaggtttagccttgggaactcacttcttgtttaactctccttttgtggagttggaaacagagttgcctttagcgattccagtggttacggctattgctctctatggtttttatcatgcttattgctttgttgagaaacacaatgagttgatgacctag

SEQ ID NO: 349 - DNA, 390 bp, Streptococcus pneumoniae
atgaaggtggaaccacgttgcgacgtcctttcgaggatgtcgcatttttttattaggatactaattatggagttgcaagaattagtggagcgcagttgggcaatccgacaagcttatcacgaactggaagttaagcatcatgattccaagtggacggtagaagaagacctcttggctttatctaatgatattggaaatttccaacgactggtgatgacaaagcaaggacgctactatgatgaaacaccctacacactggaacaaaaactttcagaaaatatctggtggctattagaactttctcaacgtttggatatagacattctgacggaaatggaaaacttcctctctgataaagaaaagcaattgaacgttaggacttggaagtag

SEQ ID NO: 350 - DNA, 975 bp, Streptococcus pneumoniae
atgcttgattggaaacaattttttctagcctatctgcgctcccgtagtcgtctttttatctatctgctttctttggcatttcttgtcttactctttcagtttttatttgccagtctaggaatttacttcctctactttttcttcttgtgttgctttgtaaccatattatttttcacttgggacatattggtggaaacgcaggtctatcgccaggaacttctctatggagagagggaagccaagtctcctttggaaatagctttagcagaaaaattagaagcgcgtgagatggaactctatcagcagaggtcaaaagcagaaagaaaactgacggatttgctggattactataccttgtgggtccatcagataaagacccccattgcagccagtcaactcttagttgcagaagtggtcgaccgccaactgaagcagcagctagaacaggaaattttcaaaatcgactcctataccaacctagttttacagtacctgcgtttagaaagtttccatgatgatttggtcttaaagcaggttcaaattgaggacttggtcaaggaaataattcgtaaatatgctcttttctttattcaaaaaggcttaaatgtcaatctacatgaccttgataaagaaatcgtgacggataaaaagtggctgctagtggttattgagcaaatcatctcaaacagtctcaagtacaccaaggaaggtggtctggagatttatatggatgaccaagagctttgtatcaaagatacgggaatcgggataaaaaacagtgatgtcctccgagtatttgaacgtggcttttcaggatacaatggccgtttgacccagcagtcctctggacttggcctttatctatctaagaaaatttctgaagaactggggcaccagattcgtatcgagtctgaggtcggaaaaggaacgacagtgcggattcagtttgctcaagtgaacttagtccttgagtaa

SEQ ID NO: 351 - DNA, 588 bp, Streptococcus pneumoniae
atggaacttaatacacacaatgctgaaatcttgctcagtgcagctaataagtcccactatccgcaggatgaactgccagagattgccctagcagggcgttcaaatgttggtaaatccagctttatcaacactatgttgaaccgtaagaatctcgcccgtacatcaggaaaacctggtaaaacccagctcctgaacttttttaacattgatgacaagatgcgctttgtggatgtgcctggttatggctatgctcgtgtttctaaaaaggaacgtgaaaagtgggggtgcatgattgaggagtacttaacgactcgggaaaatctccgtgcggttgtcagtctagttgaccttcgtcatgacccgtcagcagatgatgtgcagatgtacgaatttctcaagtattatgagattccagtcatcattgtggcgaccaaggcggacaagattcctcgtggtaaatggaacaagcatgaatcagcaatcaaaaagaaattaaactttgacccgagtgacgatttcatcctcttttcatctgtcagtaaggcagggatggatgaggcttgggatgcaatcttagaaaaattgtga

SEQ ID NO: 352 - DNA, 891 bp, Streptococcus pneumoniae
atgacaaagaaacaacttcacttggtgattgtgacagggatgagtggcgcagggaaaactgtagccattcagtccttcgaggatctaggttatttcaccattgataatatgccgccagctctcttgcctaagtttttgcagctggttgaaattaaggaagacaatcctaagttggccttggtagtggatatgcgtagccgttctttcttttcagagattcaagctgttttggatgagttggaaaatcaagatggtttggatttcaaaatcctctttttggatgcggctgataaggaattggtcgctcgttacaaggaaaccagacggagtcacccactagcagcagacggtcgtattttagatggaatcaagttggaacgtgaactcttggcacctttgaaaaatatgagccaaaatgtggtggatacgactgaactcactccacgtgagctgcgcaaaacccttgcagagcagttttcagaccaagaacaagcccagtctttccgtatcgaagtcatgtctttcggatttaagtatggaatcccgattgatgcggacttggtctttgatgtccgtttcttgccaaatccctattatttaccagaactgagaaaccaaacgggtgtggatgaacctgtttatgattatgtcatgaaccatcctgagtcagaagacttttatcaacatttattggccttgattgagccgattctgccaagttaccaaaaggaaggtaagtccgttttgaccattgccatgggatgtacgggtggacaacaccgtagtgtggcatttgctaaacgcttggcgcaggacttatccaagaattggtctgttaatgaagggcatcgcgacaaagaccgcagaaaggaaacggtaaaccgttcatga

SEQ ID NO: 353 - DNA, 978 bp, Streptococcus pneumoniae
atgagaaaaccaaagataacggtgattggtggagggactggaagtcccgtcattctaaaaagtctgcgggaaaaagatgtggaaatcgcagctatcgtgacggtggcagatgatggtggttcttcaggtgaactccgaaaaaatatgcaacagttgacaccgccaggtgatcttcgtaatgtccttgtggccatgtcggatatgcctaagttttatgagaaggtctttcagtatcggttctctgaggatgccggagcctttgctggccatccattgggaaatctcatcattgctggcttgtcagaaatgcagggttcaacctataatgccatgcagttattgagcaaatttttccatacaacagggaaaatttatccttccagtgaccatcctttgacccttcatgcagtctttcaggatgggacagaagtggctggagagagtcatattgtagaccatcgaggcataattgacaatgtctatgtgaccaatgccctaaacgatgatacgcctctggccagccgtcgagtagtgcagaccatccttgaaagtgacatgattgtcctagggccaggttccctctttacctctattttgcccaatatcgtgattaaggaaattgggcgggctcttttggaaaccaaggcagaaattgcctatgtctgcaatatcatgacccaacgtggggagacggaacactttacagatagcgaccacgtggaagtcttgcatcgtcaccttggtcgcccttttatcgacactgtcttggtgaatattgaaaaagtgcctcaggaatacatgaattccaaccgttttgatgaatacttagtgcaagtggaacacgattttgtaggtctttgtaagcaagtttcgcgcgtgatttcatctaacttccttcgtctggaaaatggcggtgccttccacgatggagatttgattgtggacgagttgatgcgcattatacaggtgaaaaaatga

SEQ ID NO: 354 - DNA, 1179 bp, Streptococcus pneumoniae
atgaaaaatttgataaagttgctaataattagattgattgttaacttagcagacagtgtattttatatagtagcattgtggcacgttagcaataattattcttcgagcatgttcttaggaatatttattgcagtaaattatctaccggatttgttactaatcttttttggaccagttattgacagagtaaatccgcaaaaaattcttataatatcaattttggttcaattagcagtggctgtaatatttttattattattaaaccaaatatcattttgggtgataatgagtctagtgtttatttcagtaatggctagctccataagttacgtgatagaagatgtgttgattcctcaagtggtagaatatgataagattgtatttgcaaattctctttttagtatttcgtataaagtattagattctatttttaattcattcgcatcatttttacaggtggcagtaggatttattttattggttaagatagatataggcatatttttacttgctctatttatattgttgttgttaaaatttagaactagcaatgcgaatatagaaaacttctctttcaaatattacaagagagaagtgttgcaaggtacaaagtttattttaaataataaattattatttaaaaccagtatttctttaacgcttataaactttttttattcatttcagacagtagttgtaccgattttttctattcgatattttgatggtccgattttttatggtatttttttaactattgctggtttgggtggtatattgggaaatatgctagcgccaatcgtaataaaatatttaaaatcgaatcaaattgttggtgtatttctttttttgaacggctcaagttggttagtagcaattgttataaaagactatactttatcacttattttatttttcgtttgttttatgtctaaaggagtcttcaatattatttttaattcgttgtaccaacaaatacctccacatcaacttcttggtagggtaaatactaccattgattctattatttcttttggaatgccaattggtagtttagttgcaggaacgcttattgatttgaatattgaattagtgttaattgctattagcataccttattttttgttttcttatattttttatacggataatggattgaaagaatttagtatatattag

SEQ ID NO: 355 - DNA, 678 bp, Streptococcus pneumoniae
atgatgtctaacaaaaataaggaaattctgatttttgcgattctctatacagtcctctttatgtttgatggcgttaaattgctggcttctttaatgccatctgccattgcaaattatcttgtttatgtagttttagctctatatggctccttcttgttcaaggatagattgatccaacaatggaaggagattagaaagactaaaagaaaattcttctttggagtcttaacaggatggctctttctcattctgatgactgttgtctttgaatttgtatcagagatgttgaagcagtttgtgggactagatggacaaggtctaaatcagtctaatattcaaagtacctttcaagaacaaccactactgatagctgtttttgcttgtgtcattggacctctggtagaagaattatttttccgtcaggtcttattgcattacttgcaggaacggttgtcaggtttactaagcattattctggtaggacttgtttttgctctgactcatatgcacagtttggctctatcagagtggattggtgcagttggttacttaggtggaggccttgccttttctattatttatgtgaaagaaaaagagaatatctactatcccctacttgttcacatgttaagcaacagcctctccttaatcattttagctatcagtatagtaaaatga

SEQ ID NO: 356 - DNA, 1158 bp, Streptococcus pneumoniae
ttgaaaaagccaattatcgaattcaaaaacgtctctaaagtttttgaagacagcaacaccaaggttctcaaagacatcaactttgagttggaagaagggaaattctacacccttctaggtgcatctggttcggggaaatcaactatcctaaacattattgcaggtttactggatgcgacgacaggagatatcatgctagacggtgttcgtatcaatgatattccaaccaacaagcgcgacgtacataccgtcttccaatcctatgccttgttcccacatatgaatgtgtttgaaaatgttgcctttccacttcgcttgcgtaaaattgataagaaagaaatcgagcagcgtgtagcggaagttctcaagatggttcagttggaaggttatgaaaaacgttccatccgcaaactttctggaggacaacgtcagcgtgtggccatcgcccgtgctatcatcaaccaaccccgtgtggtcttgttggacgagcctttatcagcgctggacttgaaattgagaacagacatgcagtacgaattgcgtgaattacaacaacgattgggcattacctttgtctttgtcactcacgatcaggaagaagctcttgccatgagtgactggattttcgttatgaatgatggcgagattgtccagtctggaacccctgtggacatctacgatgagccaatcaaccactttgttgccacctttatcggggagtcaaacatcttgccaggtaccatgattgaggactacttggtcgaatttaacggcaaacgctttgaagcggttgatggtgggatgaagccaaatgaacctgttgaggtcgttattcgtccagaggacttgcgcattacccttcctgaagaaggcaagctccaagttaaggtcgatacccagcttttccgtggagttcattatgaaattatcgcctatgacgaacttggaaatgaatggatgatccactcaacccgtaaggctatcgtgggtgaggaaatcggtctggactttgaaccagaagacatccacatcatgcgtctcaatgaaaccgaagaagagttcgatgctcgtattgaggagtacgtagaaatcgaagagcaagaagcaggtttgatcaatgcaatcgaggaggaaagagatgaagaaaacaagctctaa

SEQ ID NO: 357 - DNA, 621 bp, Streptococcus pneumoniae
atgaaatcaatgagaatcttatttttgttagctttaattcaaatcagtttgagtagctgtttcctatggaaggaatgcatcttgtcctttaaacaaagtacagcttttttcatcggaagcatggttttcgtttcaggaatctgtgctggagtaaattatctttatacccgtaagcaagaagtccatagtgtcctagccagtaagaagtcggtgaagcttttttacagtatgttactcttaattaatttgttaggagctgttcttgttttgtcagataacttgttcatcaaaaatacgctgcagcaagaattagttgactttttattgccatccttctttttcctatttgggctagatttgctgatttttttacccttgaaaaaatacgtgcgcgattttcttgctatgctggacagaaaaaagacagtgttggtgactattttagcaacacttcttttcttaagaaatccaatgaccattgtctcacttctgatttatattggactgggcttgttttttgcagcctatcttgtcccaaattcggttaagaaggaagtttccttttatggtcatattttccgagatcttgtattggtcattgttacgctcattttcttttag

SEQ ID NO: 358 - DNA, 1017 bp, Streptococcus pneumoniae
atggttaaaaaaattattggaatggtgctagctttactttctgtaactgtagtaggagtaggtgtttttgcttatactatttatcaacaagggacagaaaccttagctaaaacctataaaaaaatcggtgaagaaaccaaggttattgaagcgactgaacctctaaccattctgttaatgggagtggacaccggaaatgttgaacgaactgaaacttgggtcggtagaagtgatagcatgatcttgatgacagtgaatcctaaaacgaaaaaaacaacaatgatgagtttagagcgggatattctgacgcgcattgaatcagggaatggtcaggctcatgaagcgaaactgaactcagcatatgcagatggtggagcagagcttgctatagaaaccattcaaaaaatgatgaatatccatattgatcgctatgtgatggtcaatatgagaggattgcaaaaactagtggatgcagtaggaggtattacagtcaataatatcctaggtttcccaatttctatcagtgaccaagaagaatttaatactatttctatcggtgttggggagcaacatattgggggagaagaagccctagtctatgcacgaatgcgttaccaagatcctgagggggattatggtcgtcaaaaacgtcaacgtgaagttattcaaaaagtcatggaaaaagctctcagtttaaatagcattggtcattatcaagagattctaaaagctttgagtgacaatatgcagaccaatattgatttgtctgcaaaaagtatccctaacttgctaggctataaagattcatttaaaaccattgaaactcagcagttgcagggtgaaggagagatacttcaaggtgtttcttaccagattgtttcgagagcacatatgttggaaatgcaaaatctactccgacgttctttgggacaagaagaagttactcagcttgaaaccaatgcggttttatttgaagatttatttggcagagcacctgttggtgatgaagataattaa

SEQ ID NO: 359 - DNA, 996 bp, Streptococcus pneumoniae
atgaaaaaacaagcctatgtcattattgctctcacctccttcctatttgtcttttttttctcccacagcttgctggaaatacttgattttgactggtctatctttttgcacgatgtcgaaaaaacagaaaaatttgtctttttattgttggttttcagcatgtccatgacctgtctcttagccctgttttggcgagggatcgaagagctttctctaagaaaaatgcaggctaatctcaagcgtttattagcagggcaagaagtggttcaggttgcagatccagatttggatgccagtttcaagtccttatcaggtaaacttaaccttttgacagaggctcttcaaaaagctgaaaatcagagccttgctcaggaagaggaaatcatcgagaaggaacggaagcgaattgctcgggatttgcacgatacagtcagtcaggagttgtttgcggcccacatgattttatcgggtatcagtcagcaggctttgaaattggatagagaaaagatgcagacccagttgcagagtgtcacagctattttagaaacagcccagaaggatttgcgggttttgctcttgcatttgcgaccagttgaactggagcagaagagcttgatagaagggattcaaattcttttaaaagagcttgaggacaagagtgatcttagggttagtctcaagcagaatatgacgaaattgcctaagaaaatcgaggagcatatcttccgtatcctgcaagagttgattagcaataccctccgccatgcccaggcatcttgcctagatgtctacctctatcagacagatgttgaattgcaactgaaggtggtggacaatgggattggtttccagttagggagcttagacgacttgagttatggactgcgaaatatcaaggagcgggttgaagatatggctggaacagttcaactcttgacagctcccaagcaagggctggcggttgatatccgtattcccctgttagataaggaatga

SEQ ID NO: 360 - DNA, 867 bp, Streptococcus pneumoniae
atgattgtttccattatttctcaaggatttgtctgggctattctaggtctgggaatctttatgacatttaggattttaaactttccagatatgacgacagaaggttccttccctcttgggggagctgttgctgtcactttgataaccaaaggcgtgaacccatttttagcgacacttgttgctgtaggagcaggttgtttggctggaatggcagcaggccttctttatacaaaagggaagatcccaaccttgctctcagggattttggtgatgacttcttgtcactcaatcatgctcttgattatgggacgtgcgaatttaggcctgcttggaaccaagcaaattcaggatgttttgccttttgattcggatttgaatcaactcttgacaggtctcatctttgtgagtattgttattgctctcatgctctttttcttggacactaaactcggacaagcctatattgctacaggggataatcctgatatggctagaagtttcgggattcatactggacgcatggagctcatgggcttggtcttatcaaatggtgtgattgcccttgcaggtgccctcattgctcagcaagaaggttatgccgatgtgtctcgagggatcggggttatcgttgtggggcttgcaagtttgattattggagaagttattttcaagagtttgagcttggcagagcgtttggttactatcgttgtaggttctatcgcttatcaatttttagtgtgggcagttatcgcacttggctttaatacaagttaccttcgtttatacagtgccttgattttagcagtctgcctcatgattccaacatttaagcaaacaatcttgaaaggagccaagttaagcaaatga

SEQ ID NO: 361 - DNA, 1068 bp, Streptococcus pneumoniae
atgaaaaaaatgaaagtttggtctactgtacttgcaacgggagttgctcttactacacttgctgcttgctctggaggttcaaattctacgactgcttcttcatctgaagaaaaagctgataaaagtcaagaattagttatctattcgaactcagtctcaaatggtcgtggtgattggttaactgctaaagcaaaagaagctggttttaatataaaaatggttgatatcgctggcgctcaattagcagaccgtgttattgctgagaagaataatgcagttgcagatatggtatttggaattggtgctgttgattcaaataaaattagagatcaaaaattactagtacagtacaagcctaaatggttagataaaattgatcaatctttatcagataaagataattattataatcctgtgattgttcaaccattagttttaattggggcgcctgatgtaaaagaaatgcctaaagattggactgaattaggtagtaagtataaaggtaaatattcaatttctggtcttcaaggaggtacaggacgggcaattctagcaagtatcttagttcgataccttgatgataaaggtgaattaggtgtttccgaaaaaggttgggaagtagcaaaagaatatttgaaaaatgcatacactcttcaaaagggagaaagttcaattgttaagatgttagacaaagaagatccaatacaatatggaatgatgtggggttctggtgcattagttggacaaaaagaacaaaatgttgttttcaaagttatgactcctgagattggtgtaccatttgtaactgaacaaactatggttttaagcactagtaaaaaacaagcgttagctaaagaatttattgattggtttggtcaatcagaaattcaagtagaatatagtaagaactttggatctattcctgcaaataaagatgccctcaaagatctacctgaagatacgaagaaatttgttgatcaagtgaaaccacaaaatattgactgggaagctgttggaaagcatttggatgaatgggtagaaaaagctgaattagaatacgtacaataa

SEQ ID NO: 362 - DNA, 1011 bp, Streptococcus pneumoniae
atgattaaatttgataatattcaaattaaatatggtgattttgttgcaattgataatctgaatttagatatacatgaaggggaattttttacatttcttgggccttcaggatgtggtaaatcaactactttgagagcattggtaggttttctagatccatcatcaggaagtattgaagttaatggaacagatgtcactcatttggaacctgaaaagcgtggaattggtattgtatttcaatcttatgcgctatttccaactatgactgtttttgataatattgcatttggtttaaaagttaagaaggtagctccagatgttattaaagctaaagtatcagcagtggcagcaaaaattaagatctctgatcaacagttacagcgtaatgtatcagaattatctgggggtcaacaacaaagggtagcattggctcgtgctctggttcttgaacctaaaattctttgtctagatgaaccattgtcaaaccttgacgcaaaattacgtgtagatttgagaaaagagttgaaaagacttcaaaaagagttaggtattactactttatatgttactcatgatcaagaggaagccttgactttatctgatagaattgcagtctttaacaatggatacatcgaacaggtcggtacaccagtagagatttatcataattctcaaactgaatttgtatgtgattttattggagatattaatgttttgaccgatgaaacagtccacgaagtattattgaaaaatacaagcgttttcttagaggataaaaaaggatacattcgattagagaaagttcgattcaatcgtgaaactgaacaagattttattctaaaagggacaattattgatgttgagttttctggagttacaattcactatacaataaaagtttctgaaagtcagattcttaatgtaacaagtattgatagtcaggctgctattagatctgtcggagaaagtgtggaattatttatcacaccatcagacgttctgcaattttaa

SEQ ID NO: 363 - DNA, 1692 bp, Streptococcus pneumoniae
atgcgtcataaattaaatttaaaagattggcttattcgtttagggttaatctggttcttagtaacatttattatttatccaaactttgatctagtagtgaatgtatttgtaaaaggaggagaattttcccttgatgctgtacatcgtgttctaaaatctcagagggcacttcagagtattatgaacagttttaagttagcattttcactcattattacagttaatgtcgtaggtattctttgtgttctatttacagagtactttgatattaaaggtgctaaaattttaaaattaggttatatgacctctttaatttatggaggagtggttttagcgactggatataaatttgtctatggtccttatggattgattacaaaatttttacaaaatgttatcccttctttagaccctaactggtttattgggtatggtgcagtcttattcattatgacattttcaggaactgctaatcatacattgtttttaacaaatacaattcgaagcgttgactatcacactattgaggctgctcgaaatatgggagcaaaaccatttactgttttccgaaaagtagtgttaccaaccttaattccaactctatttgcacttactattatggtttttcttagtggtttatctgcagtagcagcacccatgattgttggtggtaaagaatttcaaactataaatccaatgattattacatttgcagggatggggaattctcgtgatttagctgccctacttgcaattattttaggtattgcaactacaattttgcttactatcatgaataagatagaaaaaggtggaaattatatttctatctctaagactaaagcgcctcttaaaaaacaaaaaattgcgtctaagccttggaatatcattgctcacattgtagcatatggattgttcacagttttcatgcttccactaatttttatagtattatactcatttacagatccagttgcaattcaaacaggtaacttaacattatcaaactttactttagaaaattatcgcttattctttagtaatagtgcggcattctctccattcttggtcagctttatttattctattattgctgcgacaacagcaacaattctcgcagttgtatttgctcgtgttgtcagaaaacataaatctcgttttgatttcttatttgaatatggtgctctacttccttggttactaccaagtacacttttagcagtaagtttattatttacttttaatcagccacaatttcttgtcttgaatcagattttggtaggtagtttggtaattctacttattgcatatatagttgtaaaaatcccattttcttatagaatggtacgtgctattttatttagtgttgatgatgagatggaagatgcagcaagaagtatgggtgcttcacctttttatactatgatgaaggttatcattccatttattttaccggttgttctctctgttattgctttaaactttaactctttattaactgacttcgacttatctgtattcctttaccatcccctagctcaaccattaggtattacgattcgatctgcaggtgatgaaacagcaacatctaatgcacaagctctggtatttgtttatacaattgttctgatgattatttctggaacggtattatacttcacacaaagaccggggcgtaaagtaaggaaataa

SEQ ID NO: 364 - protein, 5 aa, Artificial Sequence
  SITE (3): Xaa=any amino acid; Description of Artificial Sequence: Cell wall anchoring motif
LPXTG

SEQ ID NO: 365 - DNA, 18 bp, Artificial Sequence
  Description of Artificial Sequence: Primer
gcgggatccgccaccatg

SEQ ID NO: 366 - DNA, 10 bp, Artificial Sequence
  Description of Artificial Sequence: Primer
ttgcggccgc

SEQ ID NO: 367 - DNA, 38 bp, Artificial Sequence
  Description of Artificial Sequence: Primer
cggatccgccaccatgtcttctaatgaatctgccgatg

SEQ ID NO: 368 - DNA, 39 bp, Artificial Sequence
  Description of Artificial Sequence: Primer
ttgcggccgcctgtttagattggatatctgtaaagactt

SEQ ID NO: 369 - DNA, 40 bp, Artificial Sequence
  Description of Artificial Sequence: Primer
cgcggatccgccaccatggattttccttcaaatttggagg

SEQ ID NO: 370 - DNA, 29 bp, Artificial Sequence
  Description of Artificial Sequence: Primer
ttgcggccgcaccgtactggctgctgact

SEQ ID NO: 371 - DNA, 39 bp, Artificial Sequence
  Description of Artificial Sequence: Primer
cggatccgccaccatgagtgagatcaaaattattaacgc

SEQ ID NO: 372 - DNA, 29 bp, Artificial Sequence
  Description of Artificial Sequence: Primer
ttgcggccgccgttccatggttgactcct

SEQ ID NO: 373 - DNA, 38 bp, Artificial Sequence
  Description of Artificial Sequence: Primer
cgcggatccgccaccatgtgggacatattggtggaaac

SEQ ID NO: 374 - DNA, 32 bp, Artificial Sequence
  Description of Artificial Sequence: Primer
ttgcggccgcttcacttgagcaaactgaatcc

SEQ ID NO: 375 - DNA, 42 bp, Artificial Sequence
  Description of Artificial Sequence: Primer
cgcggatccgccaccatgtcacaagaaaaaacaaaaaatgaa

SEQ ID NO: 376 - DNA, 28 bp, Artificial Sequence
  Description of Artificial Sequence: Primer
ttgcggccgcatcgacgtagtctccgcc

SEQ ID NO: 377 - DNA, 43 bp, Artificial Sequence
  Description of Artificial Sequence: Primer
cgcggatccgccaccatgctggttggaactttctactatcaat

SEQ ID NO: 378 - DNA, 29 bp, Artificial Sequence
  Description of Artificial Sequence: Primer
ttgcggccgcaactttcgtccctttttgg

SEQ ID NO: 379 - DNA, 34 bp, Artificial Sequence
  Description of Artificial Sequence: Primer
cgcggatccgccaccatgggcaattctggcggaa

SEQ ID NO: 380 - DNA, 35 bp, Artificial Sequence
  Description of Artificial Sequence: Primer
ttgcggccgcttgtttcatagcttttttgattgtt

SEQ ID NO: 381 - DNA, 39 bp, Artificial Sequence
  Description of Artificial Sequence: Primer
cgcggatccgccaccatgctattgatacgaaatgcaggg

SEQ ID NO: 382 - DNA, 37 bp, Artificial Sequence
  Description of Artificial Sequence: Primer
ttgcggccgcaacataatctagtaaataagcgtagcc

SEQ ID NO: 383 - DNA, 34 bp, Artificial Sequence
  Description of Artificial Sequence: Primer
cgcggatccgccaccatgacggcgacgaattttc

SEQ ID NO: 384 - DNA, 35 bp, Artificial Sequence
  Description of Artificial Sequence: Primer
ttgcggccgcttaattcgtttttgaactagttgct

SEQ ID NO: 385 - DNA, 40 bp, Artificial Sequence
  Description of Artificial Sequence: Primer
cgcggatccgccaccatggctgtttttcttcgctatcatg

SEQ ID NO: 386 - DNA, 34 bp, Artificial Sequence
  Description of Artificial Sequence: Primer
ttgcggccgctttcttcaacaaaccttgttcttg

SEQ ID NO: 387 - DNA, 39 bp, Artificial Sequence
  Description of Artificial Sequence: Primer
cgcggatccgccaccatgggtaaccgctcttctcgtaac

SEQ ID NO: 388 - DNA, 31 bp, Artificial Sequence
  Description of Artificial Sequence: Primer
ttgcggccgcgcttccatcaaggattttagc

What is claimed is:

1. A method for prophylactic treatment of *S. pneumoniae* infection comprising delivering to a patient in need thereof an isolated polypeptide comprising the amino acid sequence of SEQ ID NO:162.

2. The method of claim 1, wherein the polypeptide is formulated as a vaccine which comprises one or more additional components selected from excipients, diluents, adjuvants, or the like.

3. The method of claim 1 wherein said polypeptide is expressed from a recombinant vector.

\* \* \* \* \*